United States Patent
Zhu et al.

(10) Patent No.: US 10,865,441 B2
(45) Date of Patent: Dec. 15, 2020

(54) MUTANT TAQ POLYMERASE FOR FASTER AMPLIFICATION

(71) Applicant: AbClonal Science, Inc., Woburn, MA (US)

(72) Inventors: Zhenyu Zhu, Lynnfield, MA (US); Dapeng Sun, Lexington, MA (US)

(73) Assignee: AbClonal Science, Inc., Woburn, MA (US)

( * ) Notice: Subject to any disclaimer, the term of this patent is extended or adjusted under 35 U.S.C. 154(b) by 0 days.

(21) Appl. No.: 16/813,425

(22) Filed: Mar. 9, 2020

(65) Prior Publication Data

US 2020/0291455 A1 Sep. 17, 2020

Related U.S. Application Data

(60) Provisional application No. 62/818,011, filed on Mar. 13, 2019.

(51) Int. Cl.
| | |
|---|---|
| *C12N 9/52* | (2006.01) |
| *C12Q 1/686* | (2018.01) |
| *C12N 9/12* | (2006.01) |
| *C12N 15/63* | (2006.01) |

(52) U.S. Cl.
CPC .............. *C12Q 1/686* (2013.01); *C12N 9/12* (2013.01); *C12N 15/63* (2013.01); *C12Q 2521/10* (2013.01); *C12Q 2527/101* (2013.01); *C12Q 2533/101* (2013.01)

(58) Field of Classification Search
CPC ................................ C12N 9/1252; C12N 9/52
See application file for complete search history.

(56) References Cited

U.S. PATENT DOCUMENTS

| | | | | |
|---|---|---|---|---|
| 2007/0020653 | A1* | 1/2007 | Holliger | C12N 9/1252 435/6.14 |
| 2013/0034879 | A1* | 2/2013 | Skirgaila | C12N 9/1252 435/91.2 |
| 2013/0040365 | A1* | 2/2013 | Vander Horn | C12N 9/1252 435/194 |
| 2013/0217007 | A1* | 8/2013 | Kamtekar | C12Y 207/07007 435/6.1 |
| 2017/0051326 | A1 | 2/2017 | Bourn et al. | |
| 2018/0208911 | A1* | 7/2018 | Reed | C12N 9/1252 |

FOREIGN PATENT DOCUMENTS

| | | | |
|---|---|---|---|
| WO | 2010062777 | * | 6/2010 |
| WO | 2016183294 | * | 11/2016 |

OTHER PUBLICATIONS

Kermekchiev et al. 2009; Mutants of Taq DNA polymerase resistant to PCT inhibitors allows DNA amplification from whole blood and crude soil samples. Nucleic Acids Research 37(5): e40, pp. 1-14.*
Yamagami et al. 2014; Mutant Taq DNA polymerases with improved elongation ability as a useful reagent for genetic engineering. Frontiers in Microbiology. 5, article 461, pp. 1-10.*
Suzuki et al. 1996; Random mutagenesis of Thermus aquaticus DNA polymerase I: Concordance of immutable sites in vivo with crystal structure. Pro. Natl. Acad. Sci. 93: 9670-9675.*
Fisher Scientific downloaded Jun. 25, 2020 on the web at fishersci.com/shop/products/lambda-dna-250ug/50811747.*
PCT/US20/21747 Prior art discussion in Invitation.

* cited by examiner

*Primary Examiner* — Karen Cochrane Carlson
(74) *Attorney, Agent, or Firm* — Eric P. Mirabel

(57) ABSTRACT

The invention includes a mutant Taq polymerase, which can significantly extend and amplify a target sequence where the extension conditions are time limited to as little as one second. The mutant Taq polymerase, or a biologically active fragment thereof, has one or more substitutions differing from the wild type as shown in Table I.

26 Claims, 5 Drawing Sheets

Specification includes a Sequence Listing.

MUTANT TAQ POLYMERASE FOR FASTER AMPLIFICATION

SEQUENCE LISTING

The instant application contains a Sequence Listing which has been submitted electronically in ASCII format and is hereby incorporated by reference in its entirety. Said ASCII copy, created on Feb. 27, 2020, is named Abclonal-Fast-_SL.txt and is 2,224,491 bytes in size.

BACKGROUND

During the polymerase chain reaction (PCR) for DNA amplification, the target:primer:polymerase:dNTP:buffer mixture is subjected to successive rounds of heating at different temperatures to facilitate target DNA strand de-annealing (usually performed at about 90-99° C.), primer:target DNA strand annealing (usually performed at about 40-70° C.), and DNA polymerase-mediated primer elongation (usually performed at about 50-72° C.) to create new complementary amplicon strands. The reaction may include as many as 25-45 rounds of cycling to yield sufficient amplification.

PCR is usually conducted using thermostable DNA polymerases that can withstand the high temperatures associated with de-annealing without suffering inactivation by heat-induced protein denaturation.

Increasing the speed of PCR can be a significant commercial advantage, as amplified sample can be generated more quickly, with fewer heating and cooling cycles. The existing Taq polymerases extend primers at a limited rate.

Accordingly, a thermostable DNA polymerase which enables PCR amplification at an increased rate is clearly needed.

SUMMARY

The invention includes mutant Taq polymerase with one or more point mutations differing from the wild type (SEQ ID NO: 4 shows the nucleotide wild type sequence with a C-terminal His tag; SEQ ID NO: 5 shows the wild type amino acid sequence), having one or more of the amino acid point substitution shown below in Table I (at one or more of the following positions):

Table I—Mutations and Corresponding Sequence ID Numbers

D732C (SEQ ID NOS: 10-11), D732G (SEQ ID NOS: 12-13), D732H (SEQ ID NOS: 14-15), D732N (SEQ ID NOS: 16-17), D732P (SEQ ID NOS: 18-19), D732Q (SEQ ID NOS: 20-21), D732S (SEQ ID NOS: 22-23), D732T (SEQ ID NOS: 24-25)

E39K (SEQ ID NOS: 26-27)

E39K/E230K (SEQ ID NOS: 28-29), E39K/D320R (SEQ ID NOS: 30-31), E39K/E507K (SEQ ID NOS: 32-33), E39K/E520K (SEQ ID NOS: 34-35), E39K/E537K (SEQ ID NOS: 36-37), E39K/D578R (SEQ ID NOS: 38-39), E39K/D732R (SEQ ID NOS: 40-41), E39K/E742K (SEQ ID NOS: 42-43), E39K/E189K (SEQ ID NOS: 44-45)

E101K (SEQ ID NOS: 46-47)
E117K (SEQ ID NOS: 48-49)
E130K (SEQ ID NOS: 50-51)
K131E (SEQ ID NOS: 52-53)
E132K (SEQ ID NOS: 54-55)
D144R (SEQ ID NOS: 6-7)
E159K (SEQ ID NOS: 56-57)

E189C (SEQ ID NOS: 58-59), E189D (SEQ ID NOS: 60-61), E189K (SEQ ID NOS: 62-63)

E189K/E230K (SEQ ID NOS: 64-65), E189K/E507K (SEQ ID NOS: 66-67), E189K/E537K (SEQ ID NOS: 68-69), E189K/D578R (SEQ ID NOS: 70-71), E189K/D732R (SEQ ID NOS: 72-73), E189K/E742K (SEQ ID NOS: 74-75)

E189K/E230K/E537K (SEQ ID NOS: 76-77), E189K/E507K/E537K (SEQ ID NOS: 78-79), E189K/E520K/E537K (SEQ ID NOS: 80-81), E189K/E230K/E507K (SEQ ID NOS: 82-83), E189K/E230K/E520K (SEQ ID NOS: 84-85), E189K/E230K/D578R (SEQ ID NOS: 86-87), E189K/E507K/D578R (SEQ ID NOS: 88-89), E189K/E230K/D732R (SEQ ID NOS: 90-91), E189K/E537K/D732R (SEQ ID NOS: 92-93), E189K/E507K/E520K (SEQ ID NOS: 94-95), E189K/E537K/D578R (SEQ ID NOS: 96-97), E189K/E537K/E742K (SEQ ID NOS: 98-99), E189K/D732R/E742K (SEQ ID NOS: 100-101)

E189L (SEQ ID NOS: 102-103), E189M (SEQ ID NOS: 104-105), E189P (SEQ ID NOS: 106-107), E189Q (SEQ ID NOS: 108-109), E189R (SEQ ID NOS: 110-111), E189T (SEQ ID NOS: 112-113), E189W (SEQ ID NOS: 114-115),

E201K (SEQ ID NOS: 116-117)
E209K (SEQ ID NOS: 118-119)

E230A (SEQ ID NOS: 120-121), E230C (SEQ ID NOS: 122-123), E230F (SEQ ID NOS: 124-125), E230H (SEQ ID NOS: 126-127), E230K (SEQ ID NOS: 128-129)

E230K/E507K (SEQ ID NOS: 130-131), E230K/E520K (SEQ ID NOS: 132-133), E230K/E537K (SEQ ID NOS: 134-135), E230K/D578R (SEQ ID NOS: 136-137), E230K/D732R (SEQ ID NOS: 138-139), E230K/E742K (SEQ ID NOS: 140-141)

E230K/E507K/E520K (SEQ ID NOS: 142-143), E230K/E507K/E537K (SEQ ID NOS: 144-145), E230K/E520K/D578R (SEQ ID NOS: 146-147), E230K/E537K/D578R (SEQ ID NOS: 148-149), E230K/E537K/D732R (SEQ ID NOS: 150-151), E230K/E507K/E742K (SEQ ID NOS: 152-153), E230K/E520K/E742K (SEQ ID NOS: 154-155), E230K/E537K/E742K (SEQ ID NOS: 156-157), E230K/D578R/E742K (SEQ ID NOS: 158-159), E230K/D732R/E742K (SEQ ID NOS: 160-161)

E230M (SEQ ID NOS: 162-163), E230N (SEQ ID NOS: 164-165), E230P (SEQ ID NOS: 166-167), E230Q (SEQ ID NOS: 168-169), E230R (SEQ ID NOS: 170-171), E230S (SEQ ID NOS: 172-173), E230T (SEQ ID NOS: 174-175), E230V (SEQ ID NOS: 176-177), E230W (SEQ ID NOS: 178-179), E230Y (SEQ ID NOS: 180-181)

E315K (SEQ ID NOS: 182-183)
D320R (SEQ ID NOS: 184-185)
L322S (SEQ ID NOS: 186-187)
A323F (SEQ ID NOS: 188-189)
R328D (SEQ ID NOS: 190-191)
G330P (SEQ ID NOS: 192-193)
R334D (SEQ ID NOS: 194-195)
P336G (SEQ ID NOS: 196-197)
E337K (SEQ ID NOS: 198-199)
P338G (SEQ ID NOS: 200-201)
Y339A (SEQ ID NOS: 202-203)
D344R (SEQ ID NOS: 204-205)
E347K (SEQ ID NOS: 206-207)
A348F (SEQ ID NOS: 208-209)
R349D (SEQ ID NOS: 210-211)
L351S (SEQ ID NOS: 212-213)
L361S (SEQ ID NOS: 214-215)
L365S (SEQ ID NOS: 216-217)
G366P (SEQ ID NOS: 218-219)
P368G (SEQ ID NOS: 220-221)

M374S (SEQ ID NOS: 222-223)
L380S (SEQ ID NOS: 224-225)
D381R (SEQ ID NOS: 226-227)
P382G (SEQ ID NOS: 228-229)
S383I (SEQ ID NOS: 230-231)
N384R (SEQ ID NOS: 232-233)
A391F (SEQ ID NOS: 234-235)
E397K (SEQ ID NOS: 236-237)
E401K (SEQ ID NOS: 238-239)
A407F (SEQ ID NOS: 240-241)
A414F (SEQ ID NOS: 242-243)
E507A (SEQ ID NOS: 244-245)
E507K/E520K (SEQ ID NOS: 246-247), E507K/E537K (SEQ ID NOS: 248-249),
E507K/D578R (SEQ ID NOS: 250-251), E507K/D732R (SEQ ID NOS: 252-253), E507K/E742K (SEQ ID NOS: 254-255)
E507K/E537K/D578R (SEQ ID NOS: 256-257), E507K/D578R/D732R (SEQ ID NOS: 258-259), E507K/E520K/E537K (SEQ ID NOS: 260-261), E507K/E520K/D578R (SEQ ID NOS: 262-263), E507K/E520K/E742K (SEQ ID NOS: 264-265), E507K/E537K/E742K (SEQ ID NOS: 266-267), E507K/D732R/E742K (SEQ ID NOS: 268-269)
E507Q (SEQ ID NOS: 270-271), E507R (SEQ ID NOS: 272-273), E507S (SEQ ID NOS: 274-275), E507T (SEQ ID NOS: 276-277), E507Y (SEQ ID NOS: 278-279)
V518A (SEQ ID NOS: 280-281)
E520V (SEQ ID NOS: 282-283)
E520K/E537K (SEQ ID NOS: 284-285)
E537A (SEQ ID NOS: 286-287), E537F (SEQ ID NOS: 288-289), E537I (SEQ ID NOS: 290-291), E537K (SEQ ID NOS: 292-293)
E537K/D732R (SEQ ID NOS: 294-295), E537K/E742K (SEQ ID NOS: 296-297)
E537K/D578R/D732R (SEQ ID NOS: 298-299)
E520K/E537K/E742K (SEQ ID NOS: 300-301)
E537R (SEQ ID NOS: 302-303), E537Y (SEQ ID NOS: 304-305)
L541S (SEQ ID NOS: 306-307)
N565R (SEQ ID NOS: 308-309)
T569A (SEQ ID NOS: 310-311)
A570F (SEQ ID NOS: 312-313)
S575I (SEQ ID NOS: 314-315)
S577I (SEQ ID NOS: 316-317)
D578F (SEQ ID NOS: 318-319), D578H (SEQ ID NOS: 320-321), D578R (SEQ ID NOS: 322-323), D578S (SEQ ID NOS: 8-9)
D578R/D732R (SEQ ID NOS: 324-325), D578R/E742K (SEQ ID NOS: 326-327)
D578V (SEQ ID NOS: 328-329)
I584S (SEQ ID NOS: 330-331)
E626K (SEQ ID NOS: 332-333)
N627R (SEQ ID NOS: 334-335)
V631S (SEQ ID NOS: 336-337)
H639E (SEQ ID NOS: 338-339)
W645A (SEQ ID NOS: 340-341)
T664I (SEQ ID NOS: 342-343)
A675F (SEQ ID NOS: 344-345)
E694K (SEQ ID NOS: 346-347)
Q698R (SEQ ID NOS: 348-349)
S699I (SEQ ID NOS: 350-351)
E708K (SEQ ID NOS: 352-353)
D732A (SEQ ID NOS: 354-355), D732K (SEQ ID NOS: 356-357), D732M (SEQ ID NOS: 358-359), D732R (SEQ ID NOS: 360-361)
D732R/E742K (SEQ ID NOS: 362-363), D732V (SEQ ID NOS: 364-365), D732Y (SEQ ID NOS: 366-367)
E742A (SEQ ID NOS: 368-369), E742D (SEQ ID NOS: 370-371), E742F (SEQ ID NOS: 372-373), E742H (SEQ ID NOS: 374-375), E742I (SEQ ID NOS: 376-377), E742K (SEQ ID NOS: 378-379), E742M (SEQ ID NOS: 380-381), E742N (SEQ ID NOS: 382-383), E742P (SEQ ID NOS: 384-385), E742T (SEQ ID NOS: 386-387), E742V (SEQ ID NOS: 388-389), E742Y (SEQ ID NOS: 390-391)
E745K (SEQ ID NOS: 392-393)
M751S (SEQ ID NOS: 394-395)
R801D (SEQ ID NOS: 396-397)
K804E (SEQ ID NOS: 398-399)
E805K (SEQ ID NOS: 400-401)
G32P (SEQ ID NOS: 402-403)
I163S (SEQ ID NOS: 404-405)
Q42R (SEQ ID NOS: 406-407)
T34I (SEQ ID NOS: 408-409)
V103S (SEQ ID NOS: 410-411)
Y116A (SEQ ID NOS: 412-413)

The invention further includes mutant Taq polymerase having one or more of the amino acid point substitution shown above and wherein the remainder of the Taq polymerase sequence is at least 70%, or at least 75%, or at least 80%, or at least 85%, or at least 90%, or at least 95%, or at least 98%, or at least 99%, identical with wild type Taq polymerase.

The invention further includes the nucleic acid sequences encoding any of the above mutant Taq polymerases, including the corresponding sequences set forth in the Sequence Listing, and all degenerate nucleic acid sequences encoding the amino acid sequences of any of the mutant Taq polymerases shown above or set forth in the Sequence Listing; as well as vectors incorporating such nucleic acid sequences and cells transformed with such nucleic acid sequences and capable of expressing any of the above mutant Taq polymerases.

The invention further includes a composition or a kit comprising any of the above mutant Taq polymerases, the nucleic acid sequences encoding them, or vectors incorporating such nucleic acid sequences. The invention also includes a process of amplifying a target nucleic acid, wherein any of the above mutant Taq polymerases are employed in a reaction mixture designed to amplify a target nucleic acid, and subjecting the reagent mixture to conditions for amplification of the target nucleic acid.

The above mutant Taq polymerases can amplify target DNA sequences faster than wild type, as demonstrated by the results in the examples and figures below.

A391F (SEQ ID NOS 234-235); E397K (SEQ ID NOS 236-237); E401K (SEQ ID NOS 238-239); A407F (SEQ ID NOS 240-241); A414F (SEQ ID NOS 242-243); E507Q (SEQ ID NOS 270-271); E507R (SEQ ID NOS 272-273);

E507T (SEQ ID NOS 276-277); E520V (SEQ ID NOS 282-283); E537K (SEQ ID NOS 292-293); E537A (SEQ ID NOS 286-287); E537F (SEQ ID NOS 288-289); E537I (SEQ ID NOS 290-291); E537R (SEQ ID NOS 302-303); E537Y (SEQ ID NOS 304-305); N565R (SEQ ID NOS 308-309); A570F (SEQ ID NOS 312-313); S575I (SEQ ID NOS 314-315); S577I (SEQ ID NOS 316-317); D578R (SEQ ID NOS 322-323); D578F (SEQ ID NOS 318-319); E337K (SEQ ID NOS 198-199); P338G (SEQ ID NOS 200-201); Y339A (SEQ ID NOS 202-203); D344R (SEQ ID NOS 204-205); E347K (SEQ ID NOS 206-207); A348F (SEQ ID NOS 208-209); R349D (SEQ ID NOS 210-211); L351S (SEQ ID NOS 212-213); L361S (SEQ ID NOS 214-215); L365S (SEQ ID NOS 216-217); G366P (SEQ ID NOS 218-219); P368G (SEQ ID NOS 220-221); M374S (SEQ ID NOS 222-223); L380S (SEQ ID NOS 224-225); D381R (SEQ ID NOS 226-227); P382G (SEQ ID NOS 228-229); S383I (SEQ ID NOS 230-231); N384R (SEQ ID NOS 232-233); E201K (SEQ ID NOS 116-117); E209K (SEQ ID NOS 118-119); E230K (SEQ ID NOS 128-129); E230A (SEQ ID NOS 120-121); E230C (SEQ ID NOS 122-123); E230F (SEQ ID NOS 124-125); E230H (SEQ ID NOS 126-127); E230N (SEQ ID NOS 164-165); E230P (SEQ ID NOS 166-167); E315S (SEQ ID NOS 182-183); D320R (SEQ ID NOS 184-185); L322S (SEQ ID NOS 186-187); A323F (SEQ ID NOS 188-189); R328D (SEQ ID NOS 190-191); G330P (SEQ ID NOS 192-193); R334D (SEQ ID NOS 194-195); P336G (SEQ ID NOS 196-197); D578R (SEQ ID NOS 322-323); G32P (SEQ ID NOS 402-403); T34I (SEQ ID NOS 408-409); E39K (SEQ ID NOS 26-27); Q42R (SEQ ID NOS 406-407); E101K (SEQ ID NOS 46-47); V103S (SEQ ID NOS 410-411); Y116A (SEQ ID NOS 412-413); E117K (SEQ ID NOS 48-49); E130K (SEQ ID NOS 50-51); K131E (SEQ ID NOS 52-53); E132K (SEQ ID NOS 54-55); D144R (SEQ ID NOS 6-7); E159K (SEQ ID NOS 56-57); I163S (SEQ ID NOS 404-405); E189K (SEQ ID NOS 62-63), E189T (SEQ ID NOS 112-113); E189W (SEQ ID NOS 114-115).

Figure 1:
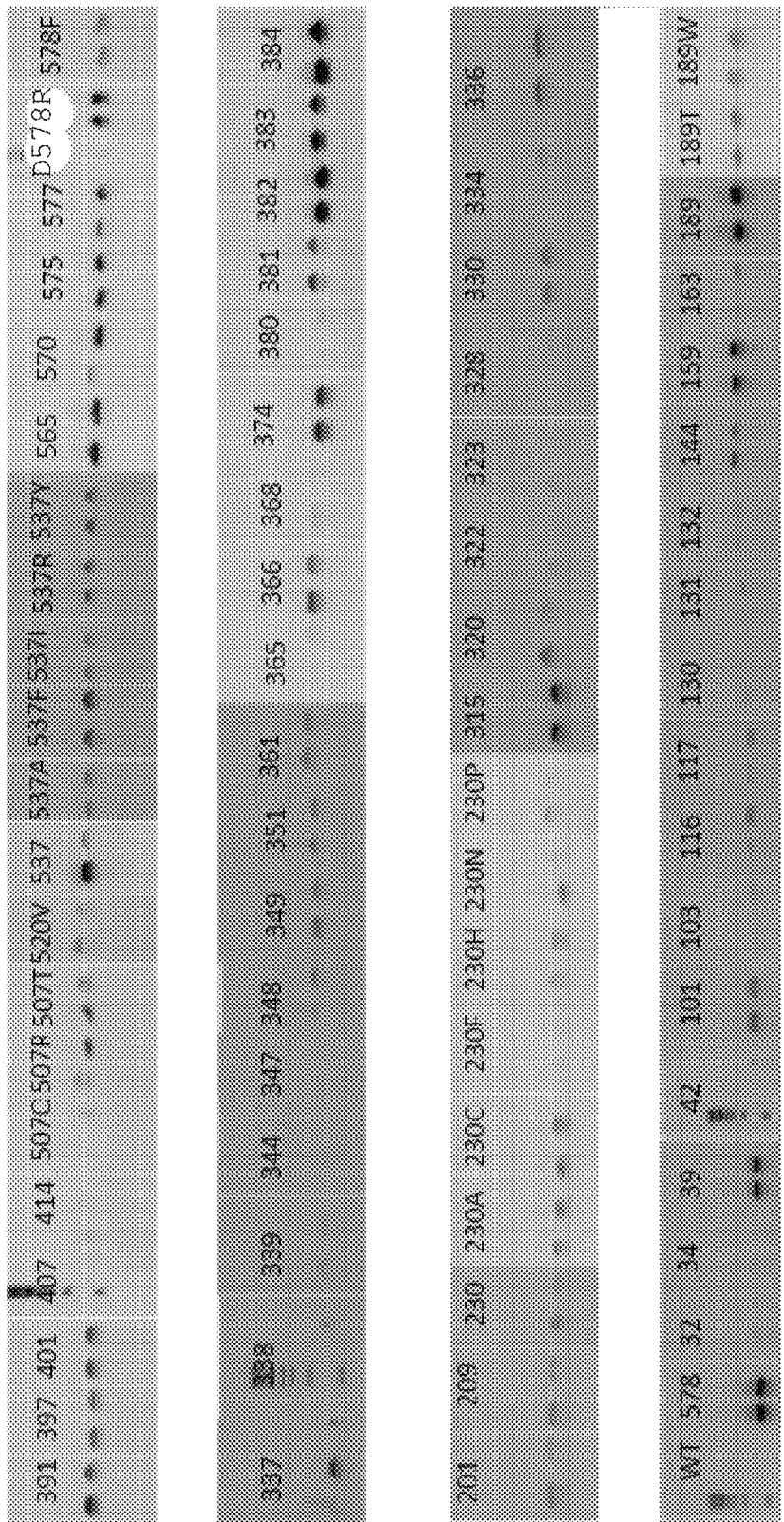
FIG. 1 shows consolidated images of a number of gels, each representing the results of PCR using one of the mutant Taq polymerases. "WT" means wild type (SEQ ID NOS 4 and 5). Each such mutant is indicated by a number or a number and a letter, which correspond to one of the mutation sites and sequences listed in Table I. All mutation sites and corresponding sequences are listed below, in the order they appear in FIG. 1. For each gel, the PCR amplification products were subject to gel electrophoresis separation following amplification of a target nucleic acid having the sequence of SEQ ID NO: 1. There are two lanes for each gel as each mutant was tested in duplicate, and the results were then merged into the consolidated gel of FIG. 1.
Figure 2:
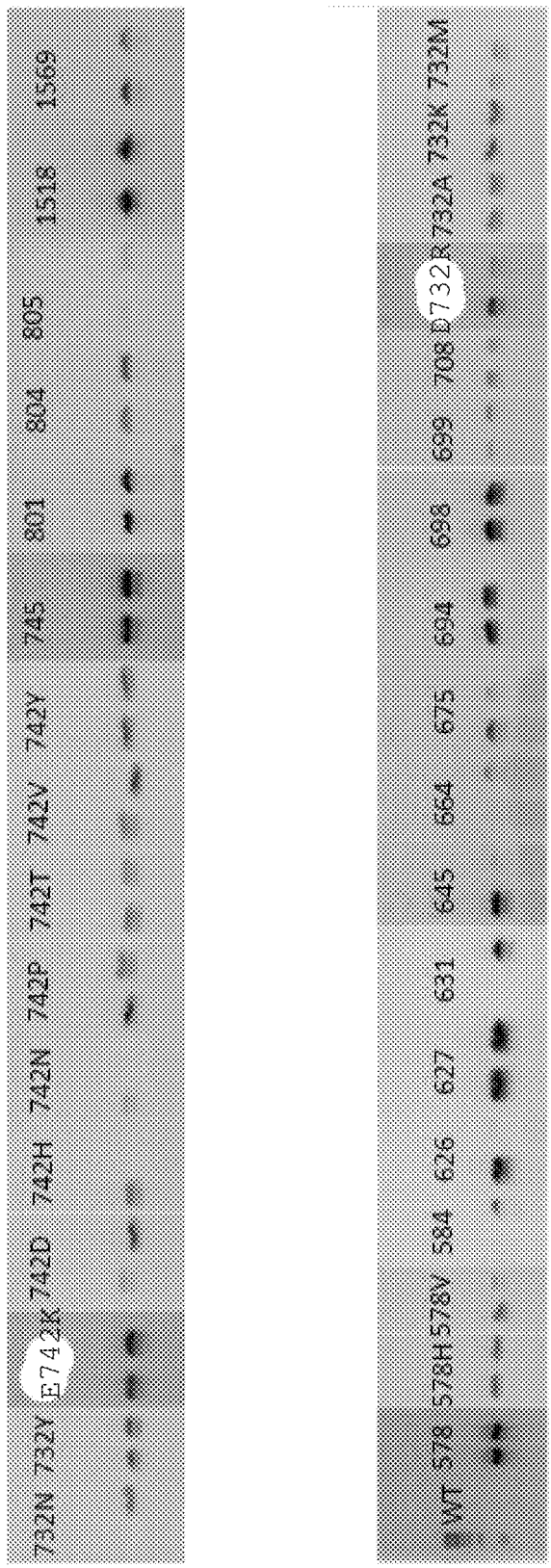

FIG. 2 shows consolidated images of a number of gels, each representing the results of PCR using one of the mutant Taq polymerases shown, with the same target and conditions as in FIG. 1, where each mutant is indicated as in FIG. 1, in the order they appear in FIG. 2. "WT" means wild type (SEQ ID NOS 4 and 5).

D732N (SEQ ID NOS 16-17); D732Y (SEQ ID NOS 366-367); E742K (SEQ ID NOS 378-379); E742D (SEQ ID NOS 370-371); E742H (SEQ ID NOS 374-375); E742N (SEQ ID NOS 382-383); E742P (SEQ ID NOS 384-385); E742T (SEQ ID NOS 386-387); E742V (SEQ ID NOS 388-389); E742Y (SEQ ID NOS 390-391); E745K (SEQ ID NOS 392-393); R801D (SEQ ID NOS 396-397); K804E (SEQ ID NOS 398-399); E805K (SEQ ID NOS 400-401); "1518" is V518A (SEQ ID NOS 280-281); "1569" is T569A (SEQ ID NOS 310-311); D578R (SEQ ID NOS 322-323); D578H (SEQ ID NOS 320-321); D578V (SEQ ID NOS 328-329); I584S (SEQ ID NOS 330-331); E626K (SEQ ID NOS 332-333); N627R (SEQ ID NOS 334-335); V631S (SEQ ID NOS 336-337); W645A (SEQ ID NOS 340-341); T664I (SEQ ID NOS 342-343); A675F (SEQ ID NOS 344-345); E694K (SEQ ID NOS 346-347); Q698R (SEQ ID NOS 348-349); S699I (SEQ ID NOS 350-351); E708K (SEQ ID NOS 352-353); D732A (SEQ ID NOS 354-355); D732K (SEQ ID NOS 356-357); D732M (SEQ ID NOS 358-359).

Figure 3:
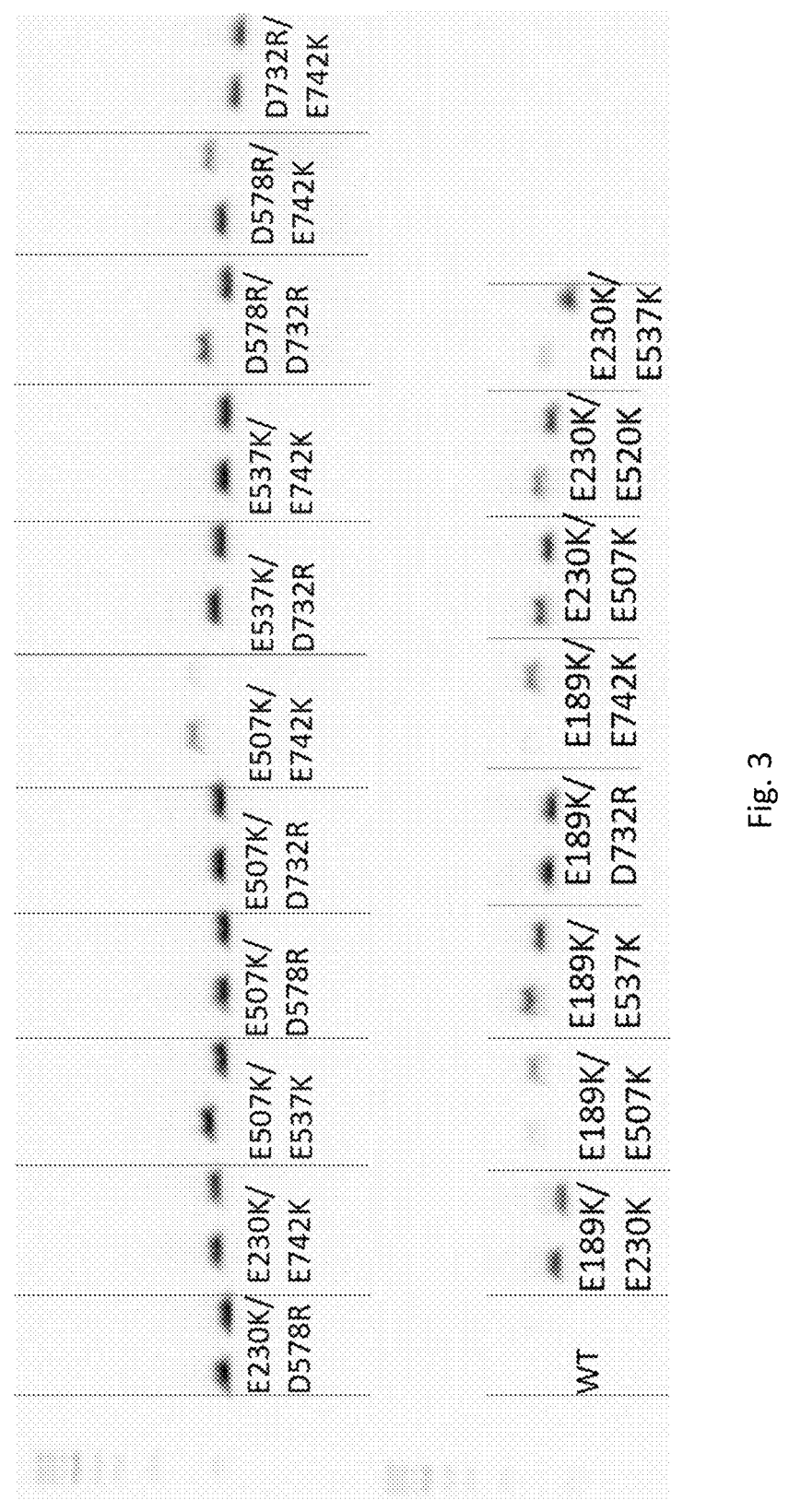

FIG. 3 shows consolidated images of a number of gels, each representing the results of PCR using one of the mutant Taq polymerases shown, with the same target and conditions as in FIG. 1, where each mutant has a mutation at two sites, and the sequence of that mutant is in Table I indicated by the same name as in FIG. 3. "WT" means wild type (SEQ ID NOS 4 and 5).

Figure 4:
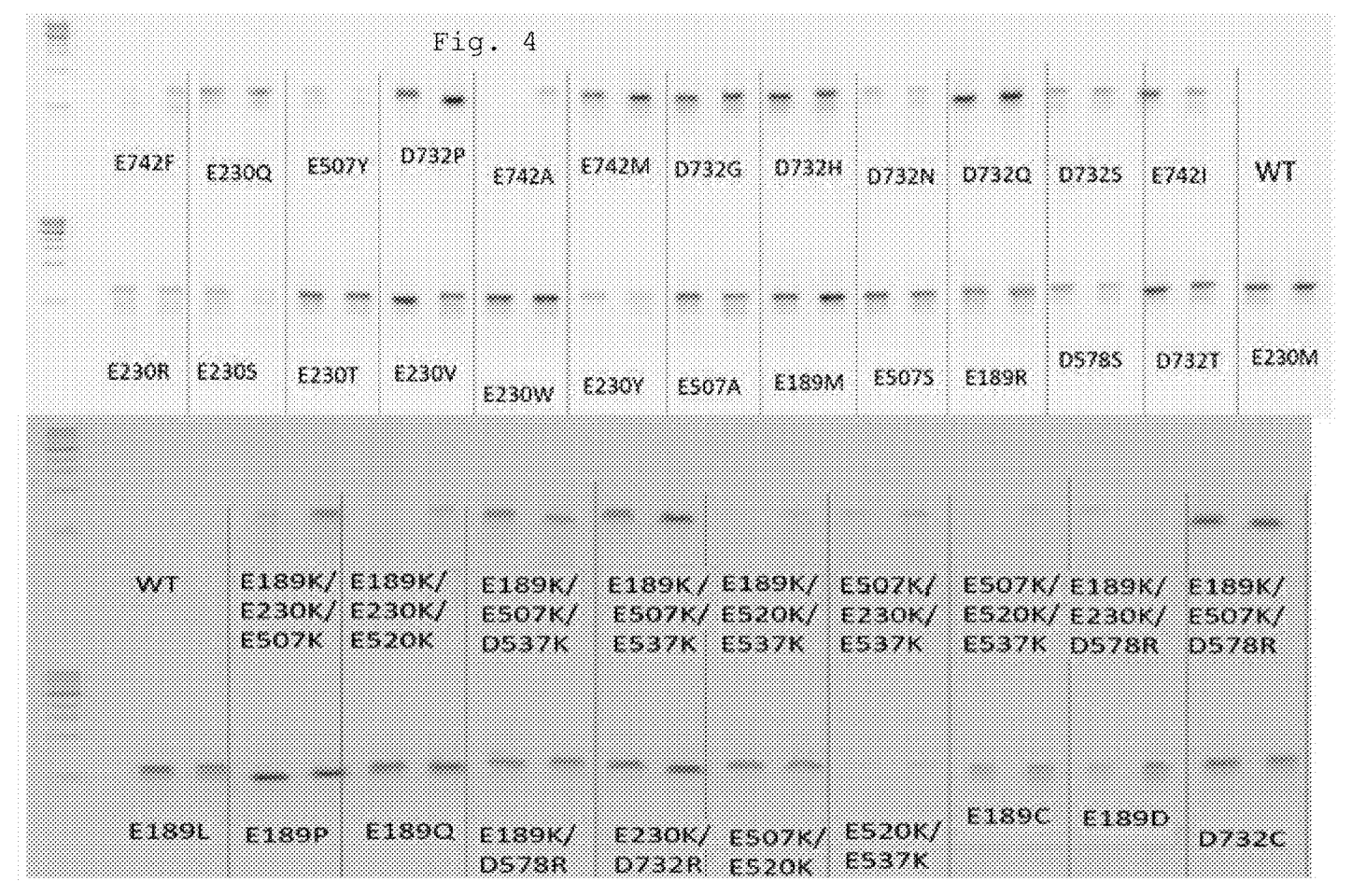

FIG. 4 shows consolidated images of a number of gels, each representing the results of PCR using one of the mutant Taq polymerases shown, with the same target and conditions as in FIG. 1, where some mutants have mutations at on site, some at two sites, and others at three sites, and the sequence of all the mutants is in Table I indicated by the same name as in FIG. 4. "WT" means wild type (SEQ ID NOS 4 and 5).

Figure 5:
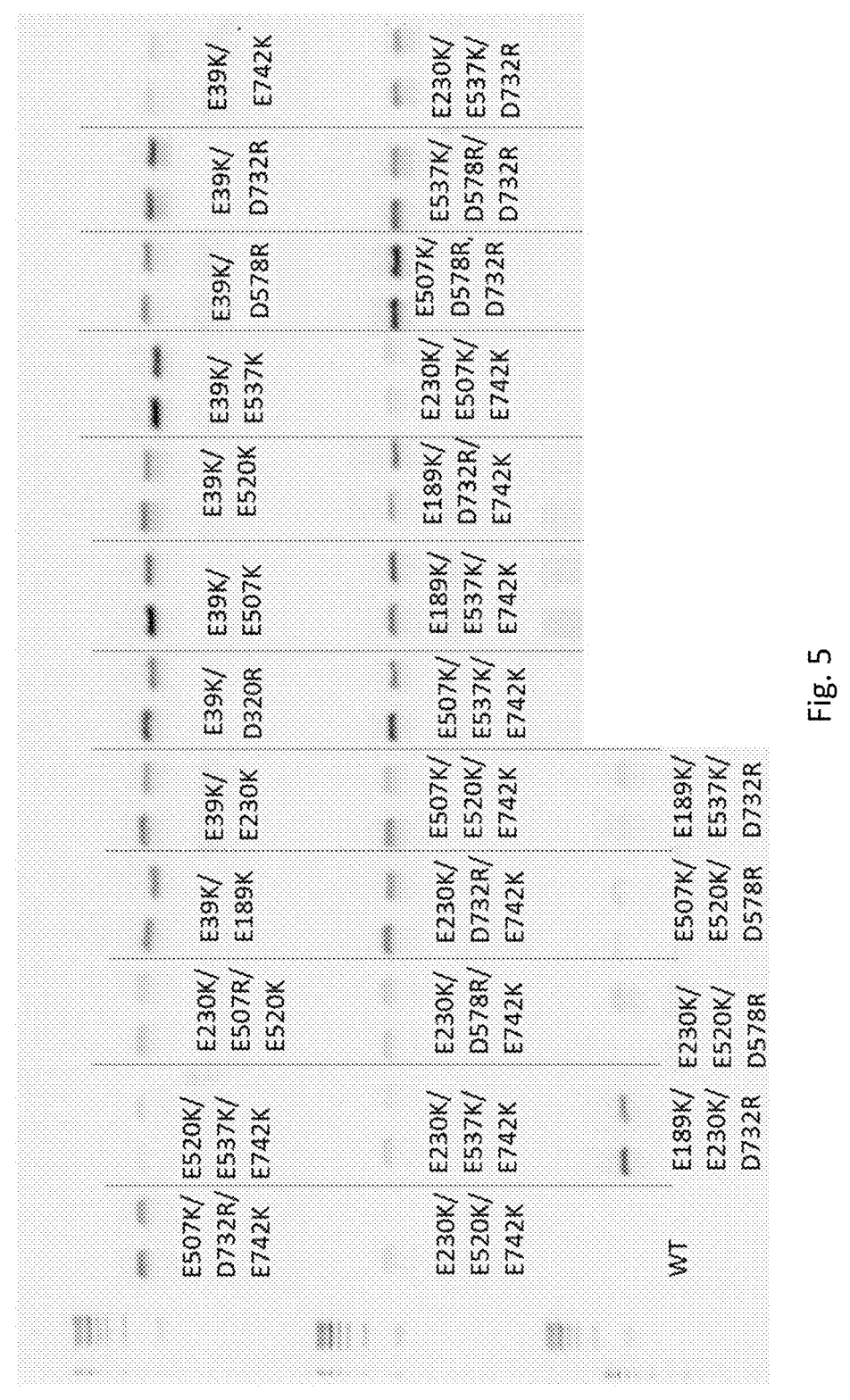

FIG. 5 shows consolidated images of a number of gels, each representing the results of PCR using one of the mutant Taq polymerases of the target SEQ ID NO: 1, with the same target and conditions as in FIG. 1, where some mutants have mutations at two sites and others at three sites, and the sequence of all the mutants is in Table I indicated by the same name as in FIG. 5. "WT" means wild type (SEQ ID NOS 4 and 5).

SUMMARY DESCRIPTION OF THE SEQUENCE LISTINGS

SEQ ID NOS 4 and 5 are the respective amino acid and nucleotide sequences of histamine-tagged wild type Taq polymerase. The amino acid and DNA sequences of the various mutants listed in Table I above, are set forth in the sequence listing attached in the same order as in Table I, starting with the first mutant sequence in Table I, which is D144R, SEQ ID NOS 6 and 7 (which are its respective amino acid and nucleotide sequences). Each mutant Taq polymerase amino acid sequence (even numbered, starting from SEQ ID NO: 6 ending at SEQ ID NO: 412) is immediately followed by its unique nucleotide encoding sequence (odd numbered, starting from SEQ ID NO: 7 and ending at SEQ ID NO: 413).

DETAILED DESCRIPTION

The term "biologically active fragment" refers to any fragment, derivative, homolog or analog of a mutant Taq polymerase that possesses an in vivo or in vitro activity that is characteristic of that biomolecule. For example, mutant Taq polymerase can be characterized by various biological activities, including DNA binding activity, nucleotide polymerization activity, primer extension activity, strand displacement activity, reverse transcriptase activity, nick-initiated polymerase activity, 3'-5' exonuclease (proofreading) activity, thermostability, ionic stability, accuracy, processivity, and the like. A "biologically active fragment" of a mutant Taq polymerase is any fragment, derivative, homolog or analog that can catalyze the polymerization of nucleotides (including homologs and analogs thereof) into a nucleic acid strand. In some embodiments, the biologically active fragment, derivative, homolog or analog of the mutant Taq polymerase possesses 10%, 20%, 30%, 40%, 50%, 60%, 70%, 75%, 80%, 85%, 90% 95%, or 98% or greater of the biological activity of the mutant Taq polymerase in any in vivo or in vitro assay of interest such as, for example, DNA binding assays, nucleotide polymerization assays (which may be template-dependent or template-independent), primer extension assays, strand displacement assays, reverse transcriptase assays, proofreading assays, accuracy assays, thermostabilty assays, ionic stability assays and the like.

The biological activity of a polymerase fragment can be assayed by measuring any of: the primer extension activity in vitro of the fragment under defined reaction conditions; the polymerization activity in vitro of the fragment under defined reaction conditions; the thermostabilty in vitro of the fragment under defined reaction conditions; the stability in vitro of the fragment under high ionic strength conditions; the accuracy in vitro of the fragment under defined reaction conditions; the processivity in vitro of the fragment under defined reaction conditions; the strand displacement activity in vitro of the fragment under defined reaction conditions; the read-length activity in vitro of the fragment under defined reaction conditions; the strand bias activity in vitro of the fragment under defined reaction conditions; the proofreading activity in vitro of the fragment under defined reaction conditions; the output of an in vitro assay such as sequencing throughput or average read length as performed by the polymerase fragment under defined reaction conditions; and, the output of a nucleotide polymerization reaction in vitro such as raw accuracy of the polymerase fragment to incorporate correct nucleotides in the nucleotide polymerization reaction under defined reaction conditions.

In some embodiments, a biologically active fragment can include any part of the DNA binding domain or any part of the catalytic domain of the mutant Taq polymerase. In some embodiments, the biologically active fragment can optionally include any 25, 50, 75, 100, 150 or more contiguous amino acid residues of the mutant Taq polymerase. A biologically active fragment of a modified polymerase can include at least 25 contiguous amino acid residues having at least 80%, 85%, 90%, 95%, 98%, or 99% identity to any one or more of the even numbered sequences from SEQ ID NO: 6 to SEQ ID NO: 412. The invention also includes the polynucleotides encoding any of the foregoing amino acid sequences (which are the coding portions of the odd numbered sequences from SEQ ID NO: 7 to SEQ ID NO: 413, where each odd numbered polynucleotide sequence encodes the previous even-numbered mutant Taq polymerase).

Biologically active fragments can arise from post transcriptional processing or from translation of alternatively spliced RNAs, or alternatively can be created through engineering, bulk synthesis, or other suitable manipulation. Biologically active fragments include fragments expressed in native or endogenous cells as well as those made in expression systems such as, for example, in bacterial, yeast, plant, insect or mammalian cells.

As used herein, the phrase "conservative amino acid substitution" or "conservative mutation" refers to the replacement of one amino acid by another amino acid with a common property. A functional way to define common properties between individual amino acids is to analyze the normalized frequencies of amino acid changes between corresponding proteins of homologous organisms (Schulz (1979) Principles of Protein Structure, Springer-Verlag). According to such analyses, groups of amino acids can be defined where amino acids within a group exchange preferentially with each other, and therefore resemble each other most in their impact on the overall protein structure (Schulz (1979) supra). Examples of amino acid groups defined in this manner can include: a "charged/polar group" including Glu, Asp, Asn, Gln, Lys, Arg, and His; an "aromatic or cyclic group" including Pro, Phe, Tyr, and Trp; and an "aliphatic group" including Gly, Ala, Val, Leu, Ile, Met, Ser, Thr, and Cys. Within each group, subgroups can also be identified. For example, the group of charged/polar amino acids can be sub-divided into sub-groups including: the "positively-charged sub-group" comprising Lys, Arg and His; the "negatively-charged sub-group" comprising Glu and Asp; and the "polar sub-group" comprising Asn and Gln. In another example, the aromatic or cyclic group can be sub-divided into sub-groups including: the "nitrogen ring sub-group" comprising Pro, His, and Trp; and the "phenyl sub-group" comprising Phe and Tyr. In another further example, the aliphatic group can be sub-divided into sub-groups including: the "large aliphatic non-polar sub-group" comprising Val, Leu, and Ile; the "aliphatic slightly-polar sub-group" comprising Met, Ser, Thr, and Cys; and the "small-residue sub-group" comprising Gly and Ala. Examples of conservative mutations include amino acid substitutions of amino acids within the sub-groups above, such as, but not limited to: Lys for Arg or vice versa, such that a positive charge can be maintained; Glu for Asp or vice versa, such that a negative charge can be maintained; Ser for Thr or vice versa, such that a free —OH can be maintained; and Gln for Asn or vice versa, such that a free —NH2 can be maintained. A "conservative variant" is a polypeptide that includes one or more amino acids that have been substituted to replace one or more amino acids of the reference polypeptide (for example, a polypeptide whose sequence is disclosed in a publication or sequence database, or whose sequence has been determined by nucleic acid sequencing) with an amino acid having common properties, e.g., belonging to the same amino acid group or sub-group as delineated above.

When referring to a gene, "mutant" means the gene has at least one base (nucleotide) change, deletion, or insertion with respect to a native or wild type gene. The mutation (change, deletion, and/or insertion of one or more nucleotides) can be in the coding region of the gene or can be in an intron, 3' UTR, 5' UTR, or promoter region. As nonlimiting examples, a mutant gene can be a gene that has an insertion within the promoter region that can either increase or decrease expression of the gene; can be a gene that has a deletion, resulting in production of a nonfunctional protein, truncated protein, dominant negative protein, or no protein; or, can be a gene that has one or more point mutations leading to a change in the amino acid of the encoded protein or results in aberrant splicing of the gene transcript.

"Naturally-occurring" or "wild-type" refers to the form found in nature. For example, a naturally occurring or wild-type polypeptide or polynucleotide sequence is a sequence present in an organism, like the Taq polymerase sequence, which has not been intentionally modified by human manipulation.

The terms "percent identity" or "homology" with respect to nucleic acid or polypeptide sequences are defined as the percentage of nucleotide or amino acid residues in the candidate sequence that are identical with the known polypeptides, after aligning the sequences for maximum percent identity and introducing gaps, if necessary, to achieve the maximum percent homology. N-terminal or C-terminal insertion or deletions shall not be construed as affecting homology. Homology or identity at the nucleotide or amino acid sequence level can be determined by BLAST (Basic Local Alignment Search Tool) analysis using the algorithm employed by the programs blastp, blastn, blastx, tblastn, and tblastx (Altschul (1997), Nucleic Acids Res. 25, 3389-3402, and Karlin (1990), Proc. Natl. Acad. Sci. USA 87, 2264-2268), which are tailored for sequence similarity searching. The approach used by the BLAST program is to first consider similar segments, with and without gaps, between a query sequence and a database sequence, then to evaluate the statistical significance of all matches that are identified, and finally to summarize only those matches which satisfy a preselected threshold of significance. For a discussion of basic issues in similarity searching of sequence databases, see Altschul (1994), Nature Genetics 6, 119-129. The search parameters for histogram, descriptions, alignments, expect (i.e., the statistical significance threshold for reporting matches against database sequences), cutoff, matrix, and filter (low complexity) can be at the default settings. The default scoring matrix used by blastp, blastx, tblastn, and tblastx is the BLOSUM62 matrix (Henikoff (1992), Proc. Natl. Acad. Sci. USA 89, 10915-10919), recommended for query sequences over 85 units in length (nucleotide bases or amino acids).

Using the Mutant Taq Polymerase

In some embodiments, the invention relates to methods (and related kits, systems, apparatuses and compositions) for performing a nucleotide polymerization reaction comprising or consisting of contacting a mutant Taq polymerase or a biologically active fragment thereof with a nucleic acid template in the presence of one or more nucleotides, and polymerizing at least one of the one or more nucleotides using the modified polymerase or the biologically active fragment thereof. The mutant Taq polymerase or the biologically active fragment thereof includes one or more amino acid modifications set forth in Table I relative to wild type, and the mutant Taq polymerase or the biologically active fragment thereof provides faster amplification of a target sequence than wild type.

In some embodiments, the method can further include polymerizing at least one nucleotide in a template-dependent fashion. In some embodiments, the polymerizing is performed under thermocycling conditions. In some embodiments, the method can further include hybridizing a primer to the nucleic acid template prior to, during, or after the contacting, and where the polymerizing includes polymerizing at least one nucleotide onto an end of the primer using the mutant Taq polymerase or the biologically active fragment thereof. In some embodiments, the polymerizing is performed in the proximity of a sensor that is capable of detecting the polymerization or the biologically active fragment thereof. In some embodiments, the method can further include detecting a signal indicating the polymerization by the modified polymerase or the biologically active fragment thereof using a sensor. In some embodiments, the sensor is an ISFET. In some embodiments, the sensor can include a detectable label or detectable reagent within the polymerizing reaction.

In some embodiments, the method further includes determining the identity of the one or more nucleotides polymerized by the modified polymerase. In some embodiments, the method further includes determining the number of nucleotides polymerized by the modified polymerase.

In some embodiments, the invention relates to methods (and related kits, systems, apparatus and compositions) for detecting nucleotide incorporation comprising or consisting of performing a nucleotide incorporation reaction using a mutant Taq polymerase or a biologically active fragment thereof, a nucleic acid template, and one or more nucleotide triphosphates; generating the nucleotide incorporation; and detecting the nucleotide incorporation. Detecting nucleotide incorporation can occur via any appropriate means such as PAGE, fluorescence, dPCR quantitation, nucleotide by-product production (e.g., hydrogen ion or pyrophosphate detection; suitable nucleotide by-product detection systems include without limitation, next-generation sequencing platforms such as Rain Dance, Roche 454, and Ion Torrent Systems)) or nucleotide extension product detection (e.g., optical detection of extension products or detection of labelled nucleotide extension products). In some embodiments, the methods (and related kits, systems, apparatus and compositions) for detecting nucleotide incorporation include or consist of detecting nucleotide incorporation using a mutant Taq polymerase or a biologically active fragment thereof.

In some embodiments, the invention relates to methods (and related kits, systems, apparatus and compositions) for amplifying a nucleic acid by contacting it with a mutant Taq polymerase or a biologically active fragment thereof under suitable conditions for amplification of the nucleic acid; amplifying the nucleic acid using a polymerase chain reaction, emulsion polymerase chain reaction, isothermal amplification reaction, recombinase polymerase amplification reaction, proximity ligation amplification, rolling circle amplification or strand displacement amplification. The amplifying includes clonally amplifying the nucleic acid in solution, as well as clonally amplifying the nucleic acid on a solid support such as a nucleic acid bead, flow cell, nucleic acid array, or wells present on the surface of the solid support.

In some embodiments the method for amplifying a nucleic acid includes amplifying it under bridge PCR conditions. The bridge PCR conditions include hybridizing one or more of the amplified nucleic acids to a solid support. The hybridized one or more amplified nucleic acids can be used as a template for further amplification.

In some embodiments, the disclosure generally relates to methods (and related kits, systems, apparatus and compositions) for synthesizing a nucleic acid by incorporating at least one nucleotide onto the end of a primer using a mutant Taq polymerase or a biologically active fragment thereof. Optionally, the method further includes detecting incorporation of the at least one nucleotide onto the end of the primer. In some embodiments, the method further includes determining the identity of at least one of the at least one nucleotide incorporated onto the end of the primer. In some embodiments, the method can include determining the identity of all nucleotides incorporated onto the end of the primer. In some embodiments, the method includes synthesizing the nucleic acid in a template-dependent manner. In some embodiments, the method can include synthesizing the nucleic acid in solution, on a solid support, or in an emulsion (such as emPCR).

Making the Mutant Taq Polymerase

In some embodiments, in order to provide a mutant Taq polymerase which can provide rapid polymerization, amino acid substitutions may be at one or more amino acids, 2 or more amino acids, 3 or more amino acids, or more, including where up to 30% of the total number of amino acids of the wild type sequence are substituted. Embodiments of the mutant Taq polymerase may be anywhere from 70% to 99.99% identical to the wild type. All embodiments of the mutant Taq polymerase include one or more of the substitutions shown in Table I, and may also include substitutions, insertions or modifications to the remaining portions of the wild type sequence. In some embodiments, in order to provide a mutant Taq polymerase which can provide rapid polymerization, several of the substitutions shown in Table I may be included. These additional substitutions are not limited to the combinations shown in Table I. Combinations in Table I, as well as other combinations, can be used with other substitutions in Table I, or with a mutant Taq polymerase which includes substitutions, insertions or modifications to other portions of the wild type sequence.

The mutant Taq polymerases of the invention can be expressed in any suitable host system, including a bacterial, yeast, fungal, baculovirus, plant or mammalian host cell. For bacterial host cells, suitable promoters for directing transcription of the nucleic acid constructs of the present disclosure, include the promoters obtained from the *E. coli* lac operon, *Streptomyces coelicolor* agarase gene (dagA), *Bacillus subtilis* levansucrase gene (sacB), *Bacillus licheniformis* alpha-amylase gene (amyL), *Bacillus stearothermophilus* maltogenic amylase gene (amyM), *Bacillus amyloliquefaciens* alpha-amylase gene (amyQ), *Bacillus licheniformis* penicillinase gene (penP), *Bacillus subtilis* xylA and xylB genes, and prokaryotic beta-lactamase gene (Villa-Kamaroff et al., 1978, Proc. Natl Acad. Sci. USA 75: 3727-3731), as well as the tac promoter (DeBoer et al., 1983, Proc. Natl Acad. Sci. USA 80: 21-25).

For filamentous fungal host cells, suitable promoters for directing the transcription of the nucleic acid constructs of the present disclosure include promoters obtained from the genes for *Aspergillus oryzae* TAKA amylase, *Rhizomucor miehei* aspartic proteinase, *Aspergillus niger* neutral alpha-amylase, *Aspergillus niger* acid stable alpha-amylase, *Aspergillus niger* or *Aspergillus awamori* glucoamylase (glaA), *Rhizomucor miehei* lipase, *Aspergillus oryzae* alkaline protease, *Aspergillus oryzae* triose phosphate isomerase, *Aspergillus nidulans* acetamidase, and *Fusarium oxysporum* trypsin-like protease (WO 96/00787), as well as the NA2-tpi promoter (a hybrid of the promoters from the genes for *Aspergillus niger* neutral alpha-amylase and *Aspergillus oryzae* triose phosphate isomerase), and mutant, truncated, and hybrid promoters thereof.

In a yeast host, useful promoters can be from the genes for *Saccharomyces cerevisiae* enolase (ENO-1), *Saccharomyces cerevisiae* galactokinase (GAL1), *Saccharomyces cerevisiae* alcohol dehydrogenase/glyceraldehyde-3-phosphate dehydrogenase (ADH2/GAP), and *Saccharomyces cerevisiae* 3-phosphoglycerate kinase. Other useful promoters for yeast host cells are described by Romanos et al., 1992, Yeast 8:423-488.

For baculovirus expression, insect cell lines derived from Lepidopterans (moths and butterflies), such as *Spodoptera frugiperda*, are used as host. Gene expression is under the control of a strong promoter, e.g., pPolh.

Plant expression vectors are based on the Ti plasmid of *Agrobacterium tumefaciens*, or on the tobacco mosaic virus (TMV), potato virus X, or the cowpea mosaic virus. A commonly used constitutive promoter in plant expression vectors is the cauliflower mosaic virus (CaMV) 35S promoter.

For mammalian expression, cultured mammalian cell lines such as the Chinese hamster ovary (CHO), COS, including human cell lines such as HEK and HeLa may be used to produce the mutant Taq polymerase. Examples of mammalian expression vectors include the adenoviral vectors, the pSV and the pCMV series of plasmid vectors, vaccinia and retroviral vectors, as well as baculovirus. The promoters for cytomegalovirus (CMV) and SV40 are commonly used in mammalian expression vectors to drive gene expression. Non-viral promoters, such as the elongation factor (EF)-1 promoter, are also known.

The control sequence for the expression may also be a suitable transcription terminator sequence, that is, a sequence recognized by a host cell to terminate transcription. The terminator sequence is operably linked to the 3' terminus of the nucleic acid sequence encoding the polypeptide. Any terminator which is functional in the host cell of choice may be used.

For example, exemplary transcription terminators for filamentous fungal host cells can be obtained from the genes for *Aspergillus oryzae* TAKA amylase, *Aspergillus niger* glucoamylase, *Aspergillus nidulans* anthranilate synthase, *Aspergillus niger* alpha-glucosidase, and *Fusarium oxysporum* trypsin-like protease.

Exemplary terminators for yeast host cells can be obtained from the genes for *Saccharomyces cerevisiae* enolase, *Saccharomyces cerevisiae* cytochrome C (CYC1), and *Saccharomyces cerevisiae* glyceraldehyde-3-phosphate dehydrogenase.

Terminators for insect, plant and mammalian host cells are also well known.

The control sequence may also be a suitable leader sequence, a nontranslated region of an mRNA that is important for translation by the host cell. The leader sequence is operably linked to the 5' terminus of the nucleic acid sequence encoding the polypeptide. Any leader sequence that is functional in the host cell of choice may be used. Exemplary leaders for filamentous fungal host cells are obtained from the genes for *Aspergillus oryzae* TAKA amylase and *Aspergillus nidulans* triose phosphate isomerase. Suitable leaders for yeast host cells are obtained from the genes for *Saccharomyces cerevisiae* enolase (ENO-1), *Saccharomyces cerevisiae* 3-phosphoglycerate kinase, *Saccharomyces cerevisiae* alpha-factor, and *Saccharomyces cerevisiae* alcohol dehydrogenase/glyceraldehyde-3-phosphate dehydrogenase (ADH2/GAP).

The control sequence may also be a polyadenylation sequence, a sequence operably linked to the 3' terminus of the nucleic acid sequence and which, when transcribed, is recognized by the host cell as a signal to add polyadenosine residues to transcribed mRNA. Any polyadenylation sequence which is functional in the host cell of choice may be used in the present invention. Exemplary polyadenylation sequences for filamentous fungal host cells can be from the genes for *Aspergillus oryzae* TAKA amylase, *Aspergillus niger* glucoamylase, *Aspergillus nidulans* anthranilate synthase, *Fusarium oxysporum* trypsin-like protease, and *Aspergillus niger* alpha-glucosidase.

The control sequence may also be a signal peptide coding region that codes for an amino acid sequence linked to the amino terminus of a polypeptide and directs the encoded polypeptide into the cell's secretory pathway. The 5' end of the coding sequence of the nucleic acid sequence may inherently contain a signal peptide coding region naturally linked in translation reading frame with the segment of the coding region that encodes the secreted polypeptide. Alternatively, the 5' end of the coding sequence may contain a signal peptide coding region that is foreign to the coding sequence. The foreign signal peptide coding region may be required where the coding sequence does not naturally contain a signal peptide coding region.

Alternatively, the foreign signal peptide coding region may simply replace the natural signal peptide coding region in order to enhance secretion of the polypeptide. However, any signal peptide coding region which directs the expressed polypeptide into the secretory pathway of a host cell of choice may be used.

Effective signal peptide coding regions for bacterial host cells are the signal peptide coding regions obtained from the genes for *Bacillus* NCIB 11837 maltogenic amylase, *Bacillus stearothermophilus* alpha-amylase, *Bacillus licheniformis* subtilisin, *Bacillus licheniformis* beta-lactamase, *Bacillus stearothermophilus* neutral proteases (nprT, nprS, nprM), and *Bacillus subtilis* prsA. Further signal peptides are described by Simonen and Palva, 1993, Microbiol Rev 57: 109-137.

Effective signal peptide coding regions for filamentous fungal host cells can be the signal peptide coding regions obtained from the genes for *Aspergillus oryzae* TAKA amylase, *Aspergillus niger* neutral amylase, *Aspergillus niger* glucoamylase, *Rhizomucor miehei* aspartic proteinase, *Humicola insolens* cellulase, and *Humicola lanuginosa* lipase.

Useful signal peptides for yeast host cells can be from the genes for *Saccharomyces cerevisiae* alpha-factor and *Saccharomyces cerevisiae* invertase. Signal peptides for other host cell systems are also well known.

The control sequence may also be a propeptide coding region that codes for an amino acid sequence positioned at the amino terminus of a polypeptide. The resultant polypeptide is known as a proenzyme or propolypeptide (or a zymogen in some cases). A propolypeptide is generally inactive and can be converted to a mature active polypeptide by catalytic or autocatalytic cleavage of the propeptide from the propolypeptide. The propeptide coding region may be obtained from the genes for *Bacillus subtilis* alkaline protease (aprE), *Bacillus subtilis* neutral protease (nprT), *Saccharomyces cerevisiae* alpha-factor, *Rhizomucor miehei* aspartic proteinase, and *Myceliophthora thermophila* lactase (WO 95/33836).

Where both signal peptide and propeptide regions are present at the amino terminus of a polypeptide, the propeptide region is positioned next to the amino terminus of a polypeptide and the signal peptide region is positioned next to the amino terminus of the propeptide region.

It may also be desirable to add regulatory sequences, which allow the regulation of the expression of the mutant Taq polymerase relative to the growth of the host cell. Examples of regulatory systems are those which cause the expression of the gene to be turned on or off in response to a chemical or physical stimulus, including the presence of a regulatory compound. In prokaryotic host cells, suitable regulatory sequences include the lac, tac, and trp operator systems. In yeast host cells, suitable regulatory systems include, as examples, the ADH2 system or GAL1 system. In filamentous fungi, suitable regulatory sequences include the TAKA alpha-amylase promoter, *Aspergillus niger* glucoamylase promoter, and *Aspergillus oryzae* glucoamylase promoter. Regulatory systems for other host cells are also well known.

Other examples of regulatory sequences are those which allow for gene amplification. In eukaryotic systems, these include the dihydrofolate reductase gene, which is amplified in the presence of methotrexate, and the metallothionein genes, which are amplified with heavy metals. In these cases, the nucleic acid sequence encoding the KRED polypeptide of the present invention would be operably linked with the regulatory sequence.

Another embodiment includes a recombinant expression vector comprising a polynucleotide encoding an engineered mutant Taq polymerase or a variant thereof, and one or more expression regulating regions such as a promoter and a terminator, and a replication origin, depending on the type of hosts into which they are to be introduced. The various nucleic acid and control sequences described above may be joined together to produce a recombinant expression vector which may include one or more convenient restriction sites to allow for insertion or substitution of the nucleic acid sequence encoding the mutant Taq polymerase at such sites. Alternatively, the nucleic acid sequences of the mutant Taq polymerase may be expressed by inserting the nucleic acid sequences or a nucleic acid construct comprising the sequences into an appropriate vector for expression. In creating the expression vector, the coding sequence is located in the vector so that the coding sequence is operably linked with the appropriate control sequences for expression.

The recombinant expression vector may be any vector (e.g., a plasmid or virus), which can be conveniently subjected to recombinant DNA procedures and can bring about the expression of the mutant Taq polymerase polynucleotide sequence. The choice of the vector will typically depend on the compatibility of the vector with the host cell into which the vector is to be introduced. The vectors may be linear or closed circular plasmids.

The expression vector may be an autonomously replicating vector, i.e., a vector that exists as an extrachromosomal entity, the replication of which is independent of chromosomal replication, e.g., a plasmid, an extrachromosomal element, a minichromosome, or an artificial chromosome. The vector may contain any means for assuring self-replication. Alternatively, the vector may be one which, when introduced into the host cell, is integrated into the genome and replicated together with the chromosome(s) into which it has been integrated. Furthermore, a single vector or plasmid or two or more vectors or plasmids which together contain the total DNA to be introduced into the genome of the host cell, or a transposon may be used.

The expression vector herein preferably contain one or more selectable markers, which permit easy selection of transformed cells. A selectable marker is a gene the product of which provides for biocide or viral resistance, resistance to heavy metals, prototrophy to auxotrophs, and the like. Examples of bacterial selectable markers are the dal genes from *Bacillus subtilis* or *Bacillus licheniformis*, or markers, which confer antibiotic resistance such as ampicillin, kanamycin, chloramphenicol (Example 1) or tetracycline resistance. Suitable markers for yeast host cells are ADE2, HIS3, LEU2, LYS2, MET3, TRP1, and URA3. Selectable markers for use in a filamentous fungal host cell include, but are not limited to, amdS (acetamidase), argB (ornithine carbamoyltransferase), bar (phosphinothricin acetyltransferase), hph (hygromycin phosphotransferase), niaD (nitrate reductase), pyrG (orotidine-5'-phosphate decarboxylase), sC (sulfate adenyltransferase), and trpC (anthranilate synthase), as well as equivalents thereof. Embodiments for use in an *Aspergillus* cell include the amdS and pyrG genes of *Aspergillus nidulans* or *Aspergillus oryzae* and the bar gene of *Streptomyces hygroscopicus*. Selectable markers for insect, plant and mammalian cells are also well known.

The expression vectors of the present invention preferably contain an element(s) that permits integration of the vector into the host cell's genome or autonomous replication of the vector in the cell independent of the genome. For integration into the host cell genome, the vector may rely on the nucleic acid sequence encoding the polypeptide or any other element of the vector for integration of the vector into the genome by homologous or nonhomologous recombination.

Alternatively, the expression vector may contain additional nucleic acid sequences for directing integration by homologous recombination into the genome of the host cell. The additional nucleic acid sequences enable the vector to be integrated into the host cell genome at a precise location (s) in the chromosome(s). The integrational elements may be any sequence that is homologous with the target sequence in the genome of the host cell. Furthermore, the integrational elements may be non-encoding or encoding nucleic acid sequences. On the other hand, the vector may be integrated into the genome of the host cell by non-homologous recombination.

For autonomous replication, the vector may further comprise an origin of replication enabling the vector to replicate autonomously in the host cell in question. Examples of bacterial origins of replication are P15A ori, or the origins of replication of plasmids pBR322, pUC19, pACYC177 (which plasmid has the P15A ori), or pACYC184 permitting replication in *E. coli*, and pUB110, pE194, pTA1060, or pAM31 permitting replication in *Bacillus*. Examples of origins of replication for use in a yeast host cell are the 2 micron origin of replication, ARS1, ARS4, the combination of ARS1 and CEN3, and the combination of ARS4 and CEN6. The origin of replication may be one having a mutation which makes it's functioning temperature-sensitive in the host cell (see, e.g., Ehrlich, 1978, Proc Natl Acad Sci. USA 75:1433).

More than one copy of a nucleic acid sequence of the mutant Taq polymerase may be inserted into the host cell to increase production of the gene product. An increase in the copy number of the nucleic acid sequence can be obtained by integrating at least one additional copy of the sequence into the host cell genome or by including an amplifiable selectable marker gene with the nucleic acid sequence where cells containing amplified copies of the selectable marker gene, and thereby additional copies of the nucleic acid sequence, can be selected for by cultivating the cells in the presence of the appropriate selectable agent.

Expression vectors for the mutant Taq polymerase polynucleotide are commercially available. Suitable commercial expression vectors include p3xFLAG™ expression vectors from Sigma-Aldrich Chemicals, St. Louis Mo., which includes a CMV promoter and hGH polyadenylation site for expression in mammalian host cells and a pBR322 origin of replication and ampicillin resistance markers for amplification in *E. coli*. Other suitable expression vectors are pBluescriptII SK(-) and pBK-CMV, which are commercially available from Stratagene, LaJolla Calif., and plasmids which are derived from pBR322 (Gibco BRL), pUC (Gibco BRL), pREP4, pCEP4 (Invitrogen) or pPoly (Lathe et al., 1987, Gene 57:193-201).

Suitable host cells for expression of a polynucleotide encoding the mutant Taq polymerase polypeptide of the present disclosure, are well known in the art and include but are not limited to, bacterial cells, such as *E. coli, Lactobacillus kefir, Lactobacillus brevis, Lactobacillus minor, Streptomyces* and *Salmonella typhimurium* cells; fungal cells, such as yeast cells (e.g., *Saccharomyces cerevisiae* or *Pichia pastoris* (ATCC Accession No. 201178)); insect cells such as *Drosophila* S2 and *Spodoptera* Sf9 cells; animal cells such as CHO, COS, BHK, 293, and Bowes melanoma cells; and plant cells. Appropriate culture mediums and growth conditions for the above-described host cells are well known in the art.

Polynucleotides for expression of the mutant Taq polymerase polypeptide may be introduced into cells by various methods known in the art. Techniques include among others, electroporation, biolistic particle bombardment, liposome mediated transfection, calcium chloride transfection, and protoplast fusion. Various methods for introducing polynucleotides into cells are known to the skilled artisan.

Polynucleotides encoding the mutant Taq polymerase can be prepared by standard solid-phase methods, according to known synthetic methods. In some embodiments, fragments of up to about 100 bases can be individually synthesized, then joined (e.g., by enzymatic or chemical litigation methods, or polymerase mediated methods) to form any desired continuous sequence. For example, polynucleotides can be prepared by chemical synthesis using, e.g., the classical phosphoramidite method described by Beaucage et al., 1981, Tet Lett 22:1859-69, or the method described by Matthes et al., 1984, EMBO J. 3:801-05, e.g., as it is typically practiced in automated synthetic methods. According to the phosphoramidite method, oligonucleotides are synthesized, e.g., in an automatic DNA synthesizer, purified, annealed, ligated and cloned in appropriate vectors. In addition, essentially any nucleic acid can be obtained from any of a variety of commercial sources, such as The Midland Certified Reagent Company, Midland, Tex., The Great American Gene Company, Ramona, Calif., ExpressGen Inc. Chicago, Ill., and Operon Technologies Inc., Alameda, Calif.

Engineered mutant Taq polymerase expressed in a host cell can be recovered from the cells and or the culture medium using any one or more of the well known techniques for protein purification, including, among others, lysozyme treatment, sonication, filtration, salting-out, ultra-centrifugation, and chromatography. Suitable solutions for lysing and the high efficiency extraction of proteins from bacteria, such as *E. coli*, are commercially available under the trade name CelLytic B™ from Sigma-Aldrich of St. Louis Mo.

Chromatographic techniques for isolation of the mutant Taq polymerase polypeptide include, among others, reverse phase chromatography high performance liquid chromatography, ion exchange chromatography, gel electrophoresis, and affinity chromatography. Conditions for purification will depend, in part, on factors such as net charge, hydrophobicity, hydrophilicity, molecular weight, molecular shape, and will be apparent to those having skill in the art.

In some embodiments, affinity techniques may be used to isolate the mutant Taq polymerase. For affinity chromatography purification, any antibody which specifically binds the mutant Taq polymerase polypeptide may be used. For the production of antibodies, various host animals, including but not limited to rabbits, mice, rats, etc., may be immunized by injection with a compound. The compound may be attached to a suitable carrier, such as BSA, by means of a side chain functional group or linkers attached to a side chain functional group. Various adjuvants may be used to increase the immunological response, depending on the host species, including but not limited to Freund's (complete and incomplete), mineral gels such as aluminum hydroxide, surface active substances such as lysolecithin, pluronic polyols, polyanions, peptides, oil emulsions, keyhole limpet hemocyanin, dinitrophenol, and potentially useful human adjuvants such as BCG (bacilli Calmette Guerin) and *Corynebacterium parvum*.

EXAMPLES

The wild type and mutant taq polymerases were used in a PCR to amplify an exemplary target nucleic acid having the sequence of

```
SEQ ID NO: 1:
CAGTGCTGCAATGATACCGCGAGACCCACGCTCACCGGCTCCAGATTTATC

AGCAATAAACCAGCCAGCCGGAAGGGCCGAGCGCAGAAGTGGTCCTGCAAC

TTTATCCGCCTCCATCCAGTCTATTAATTGTTGCCGGGAAGCTAGAGTAAG

TAGTTCGCCAGTTAATAGTTTGCGCAACGTTGTTGCCATTGCTACAGGCAT

CGTGGTGTCACGCTCGTCGTTTGGTATGGCTTCATTCAGCTCCGGTTCCCA

ACGATCAAGGCGAGTTACATGATCCCCCATGTTGTGCAAAAAAGCGGTTAG

CTCCTTCGGTCCTCCGATCGTTGTCAGAAGTAAGTTGGCCGCAGTGTTATC

ACTCATGGTTATGGCAGCACTGCATAATTCTCTTACTGTCATGCCATCCGT

AAGATGCTTTTCTGTGACTGGTGAGTACTCAACCAAGTCATTCTGAGAATA

GTGTATGCGGCGACCGAGTTGCTCTTGCCCGGCGTCAATACGGGATAATAC
```

-continued

CGCGCCACATAGCAGAACTTTAAAAGTGCTCATCATTGGAAAACGTTCTTC

GGGGCGAAAACTCTCAAGGA;

using a forward primer having

SEQ. ID NO: 2:
CAGTGCTGCAATGATACC, and a reverse primer having

SEQ. ID NO: 3:
TCCTTGAGAGTTTTCGCC.

The PCR was conducted using each of the mutant Taq polymerases, with a wild type as control, one at a time, using a Bio-Rad T100 thermocycler under the following PCR conditions: 95° C. for 3 min, 25 cycles at 95° C. for 1 sec, 60° C. for 1 sec. The resultant amplicons where then kept at 23° C. The remaining PCR conditions and reagent concentrations are below:

- 4 μl of mutant (or wild type) Taq polymerase solution, wherein the starting concentration of the Taq polymerase was 50 ng/μl;
- 1×PCR buffer (formulation below), 2 μl;
- Primer Forward, SEQ ID NO: 2 (100 uM) 0.1 μl;
- Primer Reverse, SEQ ID NO: 3 (100 uM) 0.1 μl;
- dNTP (10 mM) 0.8 μl; and
- pUC19 (1 ng/μl) 1 μl.

The reaction mixture was made up to a total volume of 20 μl by adding distilled water.

After the PCR amplification of SEQ ID NO: 1, the amplicons in the reaction mixture were separated using gel electrophoresis, under the following conditions: the gel used was 1.2% Agarose (Agarose LE, Goldbio.com, cat:A-2Q1-1000); the 1× buffer consisted of: 20 mM Tris-HCl, 80 mM Tris-Acetate, 10 mM (NH4)2SO4, 10 mM KCl, 2 mM MgSO4, 3 mM Mg-Acetate, 0.1% Triton®-X-100, pH 8.8 @ 25° C. (Research Products International, cat: T22020-10.0); the gel size was 12×14 cm; and the electrophoresis was run at 200V, for 20 minutes.

Example I

The results from the electrophoresis are shown in FIGS. 1 to 5, which include images of the individual gels for many of the mutant Taq polymerases listed in Table I.

In the test results of experiments conducted herein (as in FIGS. 1 to 5), each mutant was used in a test with only 1 second of extension time (following de-annealing). The mutants in FIGS. 1 to 5 were able to extend the SEQ ID NO: 1 oligonucleotide by more than 600 bp where extension conditions lasted only for one second. The wild type Taq polymerase did not show significant extension under the same conditions.

The experiments conducted herein show that the mutant Taq polymerases listed above and in Table I extend effectively even under extremely short extension times.

The specific methods and compositions described herein are representative of preferred embodiments and are exemplary and not intended as limitations on the scope of the invention. Other objects, aspects, and embodiments will occur to those skilled in the art upon consideration of this specification, and are encompassed within the spirit of the invention as defined by the scope of the claims. It will be readily apparent to one skilled in the art that varying substitutions and modifications may be made to the invention disclosed herein without departing from the scope and spirit of the invention. The invention illustratively described herein suitably may be practiced in the absence of any element or elements, or limitation or limitations, which is not specifically disclosed herein as essential. Thus, for example, in each instance herein, in embodiments or examples of the present invention, any of the terms "comprising", "including", containing", etc. are to be read expansively and without limitation. The methods and processes illustratively described herein suitably may be practiced in differing orders of steps, and that they are not necessarily restricted to the orders of steps indicated herein or in the claims. It is also noted that as used herein and in the appended claims, the singular forms "a," "an," and "the" include plural reference, and the plural include singular forms, unless the context clearly dictates otherwise. Under no circumstances may the patent be interpreted to be limited to the specific examples or embodiments or methods specifically disclosed herein. Under no circumstances may the patent be interpreted to be limited by any statement made by any Examiner or any other official or employee of the Patent and Trademark Office unless such statement is specifically and without qualification or reservation expressly adopted in a responsive writing by Applicants.

The invention has been described broadly and generically herein. Each of the narrower species and subgeneric groupings falling within the generic disclosure also form part of the invention. The terms and expressions that have been employed are used as terms of description and not of limitation, and there is no intent in the use of such terms and expressions to exclude any equivalent of the features shown and described or portions thereof, but it is recognized that various modifications are possible within the scope of the invention as claimed. Thus, it will be understood that although the present invention has been specifically disclosed by preferred embodiments and optional features, modification and variation of the concepts herein disclosed may be resorted to by those skilled in the art, and that such modifications and variations are considered to be within the scope of this invention as defined by the appended claims.

SEQUENCE LISTING (413 sequences)

SEQ ID NO: 1 - DNA, 581 bp, Artificial Sequence
  Description of Artificial Sequence: Synthetic polynucleotide
cagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaagga

SEQ ID NO: 2 - DNA, 18 bp, Artificial Sequence
  Description of Artificial Sequence: Synthetic primer
cagtgctgcaatgatacc

SEQ ID NO: 3 - DNA, 18 bp, Artificial Sequence
  Description of Artificial Sequence: Synthetic primer
tccttgagagttttcgcc

SEQ ID NO: 4 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 5 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 6 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKRLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 7 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataagcgtctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 8 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSSPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 9 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagctctccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 10 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPCLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 11 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccgccgctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 12 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPGLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 13 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccgggcctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 14 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPHLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 15 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccgcatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 16 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPNLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 17 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccgaatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 18 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPPLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 19 - DNA, 2535 bp, Artificial Sequence; identical to SEQ ID NO: 11
  Description of Artificial Sequence: Synthetic polynucleotide

SEQ ID NO: 20 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPQLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 21 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccgcagctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 22 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPSLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 23 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccgagcctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 24 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPTLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 25 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccgaccctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 26 - protein, 844 aa, Artificial Sequence
  Description of Artificial Sequence: Synthetic polypeptide
MRGMLPLFEPKGRVLLVDGHHLAYRTFHALKGLTTSRGKPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 27 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcaaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 28 - protein, 844 aa, Artificial Sequence
  Description of Artificial Sequence: Synthetic polypeptide
MRGMLPLFEPKGRVLLVDGHHLAYRTFHALKGLTTSRGKPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIRKKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 29 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcaaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcaaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 30 - protein, 844 aa, Artificial Sequence
  Description of Artificial Sequence: Synthetic polypeptide
MRGMLPLFEPKGRVLLVDGHHLAYRTFHALKGLTTSRGKPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWARLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 31 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcaaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcacgtttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 32 - protein, 844 aa, Artificial Sequence
  Description of Artificial Sequence: Synthetic polypeptide
MRGMLPLFEPKGRVLLVDGHHLAYRTFHALKGLTTSRGKPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTKKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 33 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcaaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccaaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 34 - protein, 844 aa, Artificial Sequence
  Description of Artificial Sequence: Synthetic polypeptide
MRGMLPLFEPKGRVLLVDGHHLAYRTFHALKGLTTSRGKPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLKALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 35 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcaaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctgaaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 36 - protein, 844 aa, Artificial Sequence
  Description of Artificial Sequence: Synthetic polypeptide
MRGMLPLFEPKGRVLLVDGHHLAYRTFHALKGLTTSRGKPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRKLTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 37 - DNA, 2535 bp, Artificial Sequence; identical to SEQ ID NO: 33
  Description of Artificial Sequence: Synthetic polynucleotide

SEQ ID NO: 38 - protein, 844 aa, Artificial Sequence
  Description of Artificial Sequence: Synthetic polypeptide
MRGMLPLFEPKGRVLLVDGHHLAYRTFHALKGLTTSRGKPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSRPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 39 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcaaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagccgtccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 40 - protein, 844 aa, Artificial Sequence
  Description of Artificial Sequence: Synthetic polypeptide
MRGMLPLFEPKGRVLLVDGHHLAYRTFHALKGLTTSRGKPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPRLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 41 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcaaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccgcgtctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 42 - protein, 844 aa, Artificial Sequence
  Description of Artificial Sequence: Synthetic polypeptide
MRGMLPLFEPKGRVLLVDGHHLAYRTFHALKGLTTSRGKPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVRKAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 43 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcaaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtaaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 44 - protein, 844 aa, Artificial Sequence
  Description of Artificial Sequence: Synthetic polypeptide
MRGMLPLFEPKGRVLLVDGHHLAYRTFHALKGLTTSRGKPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDKSDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 45 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcaaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacaaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 46 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKKLVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 47 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaaaaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 48 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYKADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 49 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctataaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 50 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAKKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 51 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccaaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 52 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEEEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 53 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaagaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 54 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKKGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 55 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaaaaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 56 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPKGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 57 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccgaaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 58 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDCSDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 59 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacccgtcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 60 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDDSDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 61 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgattcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 62 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDKSDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 63 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacaaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 64 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDKSDNLPGVKGIGEKTARKLLEEWGSLEALLKNLDRLKPAIRKKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 65 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacaaatcagataatctgccgggcgttaaaggtattggtgaaaaaaccgcccggaaattattagaagaatggggtagtctggaagcattactgaaaaatctggatcgcctgaaaccggcaattcgcaaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 66 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDKSDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTKKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 67 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacaaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccaaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 68 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDKSDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRKLTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 69 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacaaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtaaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 70 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDKSDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSRPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 71 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacaaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagccgtccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 72 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDKSDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPRLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 73 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacaaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccgcgtctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 74 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDKSDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVRKAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 75 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacaaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtaaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 76 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDKSDNLPGVKGIGEKTARKLLEEWGSLEALLKNLDRLKPAIRKKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRKLTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 77 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacaaatcagataatctgccgggcgttaaaggtattggtgaaaaaaccgcccggaaattattagaagaatggggtagtctggaagcattactgaaaaatctggatcgcctgaaaccggcaattcgcaaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtaaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 78 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDKSDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTKKTGKRSTSAAVLEALREAHPIVEKILQYRKLTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 79 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacaaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccaaaaaaaccggtaaacgctctacctcagccgcagttctggaagccctgcgcgaagcccatccgattgttgaaaaaattttacagtatcgtaaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 80 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDKSDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLKALREAHPIVEKILQYRKLTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 81 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacaaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctgaaagccctgcgcgaagcccatccgattgttgaaaaaattttacagtatcgtaaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 82 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDKSDNLPGVKGIGEKTARKLLEEWGSLEALLKNLDRLKPAIRKKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTKKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 83 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacaaatcagataatctgccgggcgttaaaggtattggtgaaaaaaccgcccggaaattattagaagaatggggtagtctggaagcattactgaaaaatctggatcgcctgaaaccggcaattcgcaaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccaaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 84 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDKSDNLPGVKGIGEKTARKLLEEWGSLEALLKNLDRLKPAIRKKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLKALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 85 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacaaatcagataatctgccgggcgttaaaggtattggtgaaaaaaccgcccggaaattattagaagaatggggtagtctggaagcattactgaaaaatctggatcgcctgaaaccggcaattcgcaaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctgaaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 86 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDKSDNLPGVKGIGEKTARKLLEEWGSLEALLKNLDRLKPAIRKKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSRPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 87 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacaaatcagataatctgccgggcgttaaaggtattggtgaaaaaaccgcccggaaattattagaagaatggggtagtctggaagcattactgaaaaatctggatcgcctgaaaccggcaattcgcaaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagccgtccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 88 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDKSDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTKKTGKRSTSAAVLEALREAHPIVEKILQYRELTKLKSTYIDPLPDLIHPRTGRLHTRFNQTATATGRLSSSRPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 89 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacaaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccaaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagccgtccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 90 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDKSDNLPGVKGIGEKTARKLLEEWGSLEALLKNLDRLKPAIRKKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPRLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 91 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacaaatcagataatctgccgggcgttaaaggtattggtgaaaaaaccgcccggaaattattagaagaatggggtagtctggaagcattactgaaaaatctggatcgcctgaaaccggcaattcgcaaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccgcgtctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 92 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDKSDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRKLTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPRLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 93 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacaaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtaaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccgcgtctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 94 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDKSDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTKKTGKRSTSAAVLKALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 95 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacaaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccaaaaaaaccggtaaacgctctacctcagccgcagttctgaaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 96 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDKSDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRKLTKLKSTYIDPLPDLIHPRTGRLHTRFNQTATATGRLSSSRPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 97 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacaaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtaaactgaccaaactgaaatctacctatattgatccgttaccggatctaattcatccgcgtaccggtcgcttacatacccgttttaatcagaccgccaccgccaccggtcgcttatcaagtagccgtccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 98 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDKSDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRKLTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVRKAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 99 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacaaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtaaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtaaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 100 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDKSDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPRLEARVKSVRKAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 101 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacaaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccgcgtctggaagcgagagttaaatcagtgcgtaaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 102 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDLSDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 103 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacctgtcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 104 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDMSDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 105 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacatgtcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 106 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDPSDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 107 - DNA, 2535 bp, Artificial Sequence; identical to SEQ ID NO: 59
  Description of Artificial Sequence: Synthetic polynucleotide

SEQ ID NO: 108 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDQSDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 109 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgaccagtcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 110 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDRSDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 111 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgaccgctcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 112 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDTSDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 113 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacacctcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 114 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDWSDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 115 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgactggtcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 116 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGKKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 117 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtaaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 118 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLKEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 119 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattaaaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 120 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIRAKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 121 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgcgaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 122 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIRCKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 123 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgctgcaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 124 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIRFKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 125 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgctttaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 126 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIRHKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 127 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgccataaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 128 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIRKKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 129 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcaaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 130 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIRKKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTKKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 131 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcaaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccaaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 132 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIRKKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLKALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 133 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcaaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctgaaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 134 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIRKKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRKLTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 135 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcaaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtaaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 136 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIRKKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSRPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 137 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcaaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagccgtccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 138 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIRKKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPRLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 139 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcaaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccgcgtctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 140 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIRKKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVRKAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 141 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcaaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtaaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 142 - protein, 844 aa, Artificial Sequence; identical to SEQ ID NO: 4
  Description of Artificial Sequence: Synthetic polypeptide

SEQ ID NO: 143 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcaaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccaaaaaaaccggtaaacgctctacctcagccgcagttctgaaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 144 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIRKKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTKKTGKRSTSAAVLEALREAHPIVEKILQYRKLTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 145 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcaaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccaaaaaaaccggtaaacgctctacctcagccgcagttctggaagccctgcgcgaagcccatccgattgttgaaaaaattttacagtatcgtaaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 146 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIRKKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLKALREAHPIVEKILQYRELTKLKSTYIDPLPDLIHPRTGRLHTRFNQTATATGRLSSSRPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 147 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcaaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctgaaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagccgtccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 148 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIRKKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRKLTKLKSTYIDPLPDLIHPRTGRLHTRFNQTATATGRLSSSRPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 149 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcaaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtaaactgaccaaactgaaatctacctatattgatccgttaccggatctaattcatccgcgtaccggtcgcttacatacccgttttaatcagaccgccaccgccaccggtcgcttatcaagtagccgtccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 150 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIRKKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRKLTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPRLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 151 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcaaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtaaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccgcgtctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 152 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIRKKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTKKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVRKAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 153 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcaaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccaaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtaaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 154 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIRKKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLKALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVRKAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 155 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcaaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctgaaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtaaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 156 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIRKKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRKLTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVRKAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 157 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcaaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtaaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtaaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 158 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIRKKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSRPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVRKAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 159 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcaaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagccgtccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtaaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 160 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIRKKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPRLEARVKSVRKAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 161 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcaaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccgcgtctggaagcgagagttaaatcagtgcgtaaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 162 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIRMKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 163 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcatgaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 164 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIRNKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 165 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcaataaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 166 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIRPKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 167 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcccgaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 168 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIRQKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 169 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgccagaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 170 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIRRKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 171 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgccgtaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 172 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIRSKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 173 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcagcaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 174 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIRTKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 175 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcaccaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 176 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIRVKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 177 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgtgaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 178 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIRWKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 179 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgctggaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 180 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIRYKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 181 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgctacaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 182 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKKPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 183 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaaaaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 184 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWARLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 185 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcacgtttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 186 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLSALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 187 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgtctgccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 188 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLFLAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 189 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctgttcctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 190 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAADGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 191 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcagacggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 192 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGPRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 193 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcccgcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 194 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHDAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 195 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatgacgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 196 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAGEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 197 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccggtgaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 198 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPKPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 199 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccgaaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 200 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEGYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 201 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaggttacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 202 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPAKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 203 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccggcgaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 204 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRRLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 205 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtcgtctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 206 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKKARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 207 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaaaaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 208 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEFRGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 209 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaattccgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 210 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEADGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 211 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcagacggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 212 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGSLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 213 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggctctttagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 214 - protein, 844 aa, Artificial Sequence; identical to SEQ ID NO: 4
  Description of Artificial Sequence: Synthetic polypeptide

SEQ ID NO: 215 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcatctagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 216 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGSGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 217 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggctctggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 218 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLPLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 219 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaccgctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 220 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLGPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 221 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgggtccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 222 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPSLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 223 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgtctctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 224 - protein, 844 aa, Artificial Sequence; identical to SEQ ID NO: 4
  Description of Artificial Sequence: Synthetic polypeptide

SEQ ID NO: 225 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgtctgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 226 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLRPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 227 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttcgtccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 228 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDGSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 229 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacggtagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 230 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPINTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 231 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgatcaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 232 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSRTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 233 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtcgtaccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 234 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVFRRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 235 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttttccgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 236 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGKWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 237 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcaaatggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 238 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEKAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 239 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaaaaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 240 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAFLSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 241 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtttcgccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 242 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFFNLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 243 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttttcaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 244 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTAKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 245 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgcgaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 246 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTKKTGKRSTSAAVLKALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 247 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccaaaaaaaccggtaaacgctctacctcagccgcagttctgaaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 248 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTKKTGKRSTSAAVLEALREAHPIVEKILQYRKLTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 249 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccaaaaaaaccggtaaacgctctacctcagccgcagttctggaagccctgcgcgaagcccatccgattgttgaaaaaattttacagtatcgtaaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 250 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTKKTGKRSTSAAVLEALREAHPIVEKILQYRELTKLKSTYIDPLPDLIHPRTGRLHTRFNQTATATGRLSSSRPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 251 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccaaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagccgtccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 252 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTKKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPRLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 253 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccaaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccgcgtctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 254 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTKKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVRKAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 255 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccaaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtaaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 256 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTKKTGKRSTSAAVLEALREAHPIVEKILQYRKLTKLKSTYIDPLPDLIHPRTGRLHTRFNQTATATGRLSSSRPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 257 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccaaaaaaaccggtaaacgctctacctcagccgcagttctggaagccctgcgcgaagcccatccgattgttgaaaaaattttacagtatcgtaaactgaccaaactgaaatctacctatattgatccgttaccggatctaattcatccgcgtaccggtcgcttacatacccgttttaatcagaccgccaccgccaccggtcgcttatcaagtagccgtccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 258 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTKKTGKRSTSAAVLEALREAHPIVEKILQYRKLTKLKSTYIDPLPDLIHPRTGRLHTRFNQTATATGRLSSSRPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPRLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 259 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccaaaaaaaccggtaaacgctctacctcagccgcagttctggaagccctgcgcgaagcccatccgattgttgaaaaaattttacagtatcgtaaactgaccaaactgaaatctacctatattgatccgttaccggatctaattcatccgcgtaccggtcgcttacatacccgttttaatcagaccgccaccgccaccggtcgcttatcaagtagccgtccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccgcgtctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 260 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTKKTGKRSTSAAVLKALREAHPIVEKILQYRKLTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 261 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccaaaaaaaccggtaaacgctctacctcagccgcagttctgaaagccctgcgcgaagcccatccgattgttgaaaaaattttacagtatcgtaaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 262 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTKKTGKRSTSAAVLKALREAHPIVEKILQYRELTKLKSTYIDPLPDLIHPRTGRLHTRFNQTATATGRLSSSRPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 263 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccaaaaaaaccggtaaacgctctacctcagccgcagttctgaaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagccgtccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 264 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTKKTGKRSTSAAVLKALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVRKAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 265 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccaaaaaaaccggtaaacgctctacctcagccgcagttctgaaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtaaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 266 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTKKTGKRSTSAAVLEALREAHPIVEKILQYRKLTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVRKAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 267 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccaaaaaaaccggtaaacgctctacctcagccgcagttctggaagccctgcgcgaagcccatccgattgttgaaaaaattttacagtatcgtaaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtaaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 268 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTKKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPRLEARVKSVRKAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 269 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccaaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccgcgtctggaagcgagagttaaatcagtgcgtaaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 270 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTQKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 271 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagacccagaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 272 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTRKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 273 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagacccgtaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 274 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTSKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 275 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagacctctaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 276 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTTKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 277 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccaccaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 278 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTYKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 279 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagacctacaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 280 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAALEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 281 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagcgctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 282 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLVALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 283 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggtggccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 284 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLKALREAHPIVEKILQYRKLTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 285 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctgaaagccctgcgcgaagcccatccgattgttgaaaaaattttacagtatcgtaaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 286 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRALTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 287 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgcgctgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 288 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRFLTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 289 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtttcctgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 290 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRILTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 291 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtattctgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 292 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRKLTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 293 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtaaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 294 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRKLTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPRLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 295 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtaaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccgcgtctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 296 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRKLTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVRKAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 297 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtaaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtaaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 298 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRKLTKLKSTYIDPLPDLIHPRTGRLHTRFNQTATATGRLSSSRPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPRLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 299 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtaaactgaccaaactgaaatctacctatattgatccgttaccggatctaattcatccgcgtaccggtcgcttacatacccgttttaatcagaccgccaccgccaccggtcgcttatcaagtagccgtccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccgcgtctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 300 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLKALREAHPIVEKILQYRKLTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVRKAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 301 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctgaaagccctgcgcgaagcccatccgattgttgaaaaaattttacagtatcgtaaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtaaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 302 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRRLTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 303 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtcgtctgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 304 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRYLTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 305 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgttatctgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 306 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKSKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 307 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaatctaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 308 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFRQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 309 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttcgtcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 310 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTAAATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 311 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccgcggccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 312 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATFTGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 313 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccttcaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 314 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLISSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 315 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttaatcagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 316 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSIDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 317 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtatcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 318 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSFPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 319 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcttcccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 320 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSHPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 321 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagccatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 322 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSRPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 323 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagccgtccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 324 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSRPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPRLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 325 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagccgtccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccgcgtctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 326 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSRPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVRKAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 327 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagccgtccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtaaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 328 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSVPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 329 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgtgccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 330 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNSPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 331 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaattctccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 332 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDKNLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 333 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacaaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 334 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDERLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 335 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaacgtctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 336 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRSFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 337 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgttcttttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 338 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIETETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 339 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattgaaaccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 340 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASAMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 341 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctctgcgatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 342 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKIINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 343 - DNA, 2534 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaatcattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 344 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSFHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 345 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcttccatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 346 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIKRYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 347 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattaaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 348 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFRSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 349 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcgttcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 350 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQIFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 351 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagatctttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 352 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIKKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 353 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattaaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 354 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPALEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 355 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggcgctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 356 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPKLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 357 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccgaaactggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 358 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPMLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 359 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccgatgctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 360 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPRLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 361 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccgcgtctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 362 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPRLEARVKSVRKAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 363 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccgcgtctggaagcgagagttaaatcagtgcgtaaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 364 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPVLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 365 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggtgctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 366 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPYLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 367 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccgtatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 368 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVRAAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 369 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgcggccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 370 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVRDAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 371 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgatgccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 372 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVRFAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 373 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtttcgccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 374 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVRHAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 375 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtcatgccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 376 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVRIAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 377 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtattgccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 378 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVRKAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 379 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtaaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 380 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVRMAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 381 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtatggccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 382 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVRNAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 383 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtaatgccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 384 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVRPAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 385 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtccggccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 386 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVRTAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 387 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtaccgccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 388 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVRVAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 389 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgtggccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 390 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVRYAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 391 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgttatgccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 392 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAKRMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 393 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccaaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 394 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNSPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 395 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaattctccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 396 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVADLAKEVMEGVYPLAVPLEVEVGIGEDWLSAKEGSGSSGHHHHHH

SEQ ID NO: 397 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcagatctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 398 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAEEVMEGVYPLAVPLEVEVGIGEDWLSAKEGSGSSGHHHHHH

SEQ ID NO: 399 - DNA, 2535 bp, Artificial Sequence; identical to SEQ ID NO: 5
  Description of Artificial Sequence: Synthetic polynucleotide

SEQ ID NO: 400 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKKVMEGVYPLAVPLEVEVGIGEDWLSAKEGSGSSGHHHHHH

SEQ ID NO: 401 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaaaaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 402 - protein, 844 aa, Artificial Sequence
  Description of Artificial Sequence: Synthetic polypeptide
MRGMLPLFEPKGRVLLVDGHHLAYRTFHALKPLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 403 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaccgctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 404 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLSTPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 405 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgtctaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 406 - protein, 844 aa, Artificial Sequence
  Description of Artificial Sequence: Synthetic polypeptide
MRGMLPLFEPKGRVLLVDGHHLAYRTFHALKGLTTSRGEPVRAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 407 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcgtgcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 408 - protein, 844 aa, Artificial Sequence
  Description of Artificial Sequence: Synthetic polypeptide
MRGMLPLFEPKGRVLLVDGHHLAYRTFHALKGLITSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 409 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgatcacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 410 - protein, 844 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELSDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 411 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattatctgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 412 - protein, 844 aa, Artificial Sequence; identical to SEQ ID NO: 4
  Description of Artificial Sequence: Synthetic polypeptide

SEQ ID NO: 413 - DNA, 2535 bp, Artificial Sequence
  Description of Artificial Sequence: Synthetic polynucleotide
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggcgcggaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

What is claimed is:

1. A mutant Taq polymerase comprising: one or more of the following amino acid mutations shown in the following even-numbered sequences, and wherein the remainder of the mutant polymerase has at least 80% amino acid sequence identity with wild type Taq polymerase, as shown in SEQ ID NO: 4 but wherein wild type Taq polymerase does not include the 6-membered histidine tag at its C-terminus and the six immediately preceding Glycine and Serine amino acids shown in SEQ ID NO: 4:

G32P (SEQ ID NOS: 402-403),
T34I (SEQ ID NOS: 408-409),
E39K/E230K (SEQ ID NOS: 28-29), E39K/D320R (SEQ ID NOS: 30-31), E39K/E507K (SEQ ID NOS: 32-33), E39K/E520K (SEQ ID NOS: 34-35), E39K/E537K (SEQ ID NOS: 36-37), E39K/D578R (SEQ ID NOS: 38-39), E39K/D732R (SEQ ID NOS: 40-41), E39K/E742K (SEQ ID NOS: 42-43), E39K/E189K (SEQ ID NOS: 44-45),
Q42R (SEQ ID NOS: 406-407),
E101K (SEQ ID NOS: 46-47),
V103S (SEQ ID NOS: 410-411),
Y116A (SEQ ID NOS: 412-413),
E117K (SEQ ID NOS: 48-49),
E130K (SEQ ID NOS: 50-51),
D144R (SEQ ID NOS: 6-7),
E159K (SEQ ID NOS: 56-57),
I163S (SEQ ID NOS: 404-405),
E189C (SEQ ID NOS: 58-59), E189D (SEQ ID NOS: 60-61), E189K/E507K (SEQ ID NOS: 66-67), E189K/E537K (SEQ ID NOS: 68-69), E189K/D578R (SEQ ID NOS: 70-71), E189K/D732R (SEQ ID NOS: 72-73), E189K/E742K (SEQ ID NOS: 74-75),
E189K/E230K/E537K (SEQ ID NOS: 76-77), E189K/E507K/E537K (SEQ ID NOS: 78-79), E189K/E520K/E537K (SEQ ID NOS: 80-81), E189K/E230K/E520K (SEQ ID NOS: 84-85), E189K/E230K/D578R (SEQ ID NOS: 86-87), E189K/E507K/D578R (SEQ ID NOS: 88-89), E189K/E230K/D732R (SEQ ID NOS: 90-91), E189K/E537K/D732R (SEQ ID NOS: 92-93), E189K/E507K/E520K (SEQ ID NOS: 94-95), E189K/E537K/D578R (SEQ ID NOS: 96-97), E189K/E537K/E742K (SEQ ID NOS: 98-99), E189K/D732R/E742K (SEQ ID NOS: 100-101),
E189L (SEQ ID NOS: 102-103), E189M (SEQ ID NOS: 104-105), E189P (SEQ ID NOS: 106-107), E189Q (SEQ ID NOS: 108-109), E189R (SEQ ID NOS: 110-111), E189T (SEQ ID NOS: 112-113), E189W (SEQ ID NOS: 114-115),
E201K (SEQ ID NOS: 116-117),
E230C (SEQ ID NOS: 122-123), E230F (SEQ ID NOS: 124-125), E230H (SEQ ID NOS: 126-127),
E230K/E520K (SEQ ID NOS: 132-133), E230K/E537K (SEQ ID NOS: 134-135), E230K/D578R (SEQ ID NOS: 136-137), E230K/D732R (SEQ ID NOS: 138-139), E230K/E742K (SEQ ID NOS: 140-141),
E230K/E507K/E520K (SEQ ID NOS: 142-143), E230K/E507K/E537K (SEQ ID NOS: 144-145), E230K/E520K/D578R (SEQ ID NOS: 146-147), E230K/E537K/D578R (SEQ ID NOS: 148-149), E230K/E537K/D732R (SEQ ID NOS: 150-151), E230K/E507K/E742K (SEQ ID NOS: 152-153), E230K/E520K/E742K (SEQ ID NOS: 154-155), E230K/E537K/E742K (SEQ ID NOS: 156-157), E230K/D578R/E742K (SEQ ID NOS: 158-159), E230K/D732R/E742K (SEQ ID NOS: 160-161),
E230M (SEQ ID NOS: 162-163), E230N (SEQ ID NOS: 164-165), E230P (SEQ ID NOS: 166-167), E230Q (SEQ ID NOS: 168-169), E230R (SEQ ID NOS: 170-171), E230S (SEQ ID NOS: 172-173), E230T (SEQ ID NOS: 174-175), E230V (SEQ ID NOS: 176-177), E230W (SEQ ID NOS: 178-179), E230Y (SEQ ID NOS: 180-181),
D320R (SEQ ID NOS: 184-185),
L322S (SEQ ID NOS: 186-187),
A323F (SEQ ID NOS: 188-189),
R328D (SEQ ID NOS: 190-191),
G330P (SEQ ID NOS: 192-193),
R334D (SEQ ID NOS: 194-195),
P336G (SEQ ID NOS: 196-197),
E337K (SEQ ID NOS: 198-199),
P338G (SEQ ID NOS: 200-201),
Y339A (SEQ ID NOS: 202-203),
D344R (SEQ ID NOS: 204-205),
E347K (SEQ ID NOS: 206-207),
A348F (SEQ ID NOS: 208-209),
R349D (SEQ ID NOS: 210-211),
L351S (SEQ ID NOS: 212-213),
L361S (SEQ ID NOS: 214-215),
L365S (SEQ ID NOS: 216-217),
G366P (SEQ ID NOS: 218-219),
P368G (SEQ ID NOS: 220-221),
M374S (SEQ ID NOS: 222-223),
L380S (SEQ ID NOS: 224-225),
D381R (SEQ ID NOS: 226-227),
P382G (SEQ ID NOS: 228-229),
S383I (SEQ ID NOS: 230-231),
N384R (SEQ ID NOS: 232-233),
A391F (SEQ ID NOS: 234-235),
A407F (SEQ ID NOS: 240-241),
A414F (SEQ ID NOS: 242-243),
E507Q (SEQ ID NOS: 270-271), E507R (SEQ ID NOS: 272-273), E507S (SEQ ID NOS: 274-275), E507T (SEQ ID NOS: 276-277), E507Y (SEQ ID NOS: 278-279),
E507K/E520K (SEQ ID NOS: 246-247), E507K/E537K (SEQ ID NOS: 248-249), E507K/D578R (SEQ ID NOS: 250-251), E507K/D732R (SEQ ID NOS: 252-253), E507K/E742K (SEQ ID NOS: 254-255),
E507K/E537K/D578R (SEQ ID NOS: 256-257), E507K/D578R/D732R (SEQ ID NOS: 258-259), E507K/E520K/E537K (SEQ ID NOS: 260-261), E507K/E520K/D578R (SEQ ID NOS: 262-263), E507K/E520K/E742K (SEQ ID NOS: 264-265), E507K/E537K/E742K (SEQ ID NOS: 266-267), E507K/D732R/E742K (SEQ ID NOS: 268-269),
E520V (SEQ ID NOS: 282-283),
E520K/E537K (SEQ ID NOS: 284-285), E520K/E537K/E742K (SEQ ID NOS: 300-301),
E537A (SEQ ID NOS: 286-287), E537F (SEQ ID NOS: 288-289), E537I (SEQ ID NOS: 290-291), E537K (SEQ ID NOS: 292-293),
E537K/D732R (SEQ ID NOS: 294-295), E537K/E742K (SEQ ID NOS: 296-297),
E537K/D578R/D732R (SEQ ID NOS: 298-299),
E537R (SEQ ID NOS: 302-303), E537Y (SEQ ID NOS: 304-305),
L541S (SEQ ID NOS: 306-307),
N565R (SEQ ID NOS: 308-309),
T569A (SEQ ID NOS: 310-311),
A570F (SEQ ID NOS: 312-313),
S575I (SEQ ID NOS: 314-315),
S577I (SEQ ID NOS: 316-317),

D578F (SEQ ID NOS: 318-319), D578H (SEQ ID NOS: 320-321), D578R (SEQ ID NOS: 322-323), D578S (SEQ ID NOS: 8-9),
D578R/D732R (SEQ ID NOS: 324-325), D578R/E742K (SEQ ID NOS: 326-327),
D578V (SEQ ID NOS: 328-329),
I584S (SEQ ID NOS: 330-331),
N627R (SEQ ID NOS: 334-335),
V631S (SEQ ID NOS: 336-337),
H639E (SEQ ID NOS: 338-339),
W645A (SEQ ID NOS: 340-341),
A675F (SEQ ID NOS: 344-345),
S699I (SEQ ID NOS: 350-351),
D732A (SEQ ID NOS: 354-355), D732C (SEQ ID NOS: 10-11), D732H (SEQ ID NOS: 14-15), D732K (SEQ ID NOS: 356-357), D732M (SEQ ID NOS: 358-359), D732P (SEQ ID NOS: 18-19), D732Q (SEQ ID NOS: 20-21), D732S (SEQ ID NOS: 22-23), D732T (SEQ ID NOS: 24-25), D732V (SEQ ID NOS: 364-365), D732Y (SEQ ID NOS: 366-367),
D732R/E742K (SEQ ID NOS: 362-363),
E742D (SEQ ID NOS: 370-371), E742F (SEQ ID NOS: 372-373), E742I (SEQ ID NOS: 376-377), E742M (SEQ ID NOS: 380-381), E742N (SEQ ID NOS: 382-383), E742P (SEQ ID NOS: 384-385), E742T (SEQ ID NOS: 386-387), E742V (SEQ ID NOS: 388-389), E742Y (SEQ ID NOS: 390-391),
E745K (SEQ ID NOS: 392-393),
M751S (SEQ ID NOS: 394-395),
R801D (SEQ ID NOS: 396-397),
and
E805K (SEQ ID NOS: 400-401).

2. The mutant Taq polymerase of claim 1 which is one of the following even-numbered amino acid sequences: G32P (SEQ ID NOS: 402-403); Q42R (SEQ ID NOS: 406-407); E101K (SEQ ID NOS: 46-47); V103S (SEQ ID NOS: 410-411); Y116A (SEQ ID NOS: 412-413); E117K (SEQ ID NOS: 48-49); E130K (SEQ ID NOS: 50-51); D144R (SEQ ID NOS: 6-7); E159K (SEQ ID NOS: 56-57); I163S (SEQ ID NOS: 404-405); E189T (SEQ ID NOS: 112-113); E189W (SEQ ID NOS: 114-115); E201K (SEQ ID NOS: 116-117); E230C (SEQ ID NOS: 122-123); E230F (SEQ ID NOS: 124-125); E230H (SEQ ID NOS: 126-127); E230N (SEQ ID NOS: 164-165); E230P (SEQ ID NOS: 166-167); D320R (SEQ ID NOS: 184-185); L322S (SEQ ID NOS: 186-187); A323F (SEQ ID NOS: 188-189); R328D (SEQ ID NOS: 190-191); G330P (SEQ ID NOS: 192-193); R334D (SEQ ID NOS: 194-195); P336G (SEQ ID NOS: 196-197); E337K (SEQ ID NOS: 198-199); P338G (SEQ ID NOS: 200-201); Y339A (SEQ ID NOS: 202-203); T34I (SEQ ID NOS: 408-409); D344R (SEQ ID NOS: 204-205); E347K (SEQ ID NOS: 206-207); A348F (SEQ ID NOS: 208-209); R349D (SEQ ID NOS: 210-211); L351S (SEQ ID NOS: 212-213); L361S (SEQ ID NOS: 214-215); L365S (SEQ ID NOS: 216-217); G366P (SEQ ID NOS: 218-219); P368G (SEQ ID NOS: 220-221); M374S (SEQ ID NOS: 222-223); L380S (SEQ ID NOS: 224-225); D381R (SEQ ID NOS: 226-227); P382G (SEQ ID NOS: 228-229); S383I (SEQ ID NOS: 230-231); N384R (SEQ ID NOS: 232-233); A391F (SEQ ID NOS: 234-235); A407F (SEQ ID NOS: 240-241); A414F (SEQ ID NOS: 242-243); E507Q (SEQ ID NOS: 270-271); E507R (SEQ ID NOS: 272-273); E507T (SEQ ID NOS: 276-277); E520V (SEQ ID NOS: 282-283); E537A (SEQ ID NOS: 286-287); E537F (SEQ ID NOS: 288-289); E537I (SEQ ID NOS: 290-291); E537K (SEQ ID NOS: 292-293); E537R (SEQ ID NOS: 302-303); E537Y (SEQ ID NOS: 304-305); N565R (SEQ ID NOS: 308-309); A570F (SEQ ID NOS: 312-313); S575I (SEQ ID NOS: 314-315); S577I (SEQ ID NOS: 316-317); D578F (SEQ ID NOS: 318-319); D578R (SEQ ID NOS: 322-323).

3. The mutant Taq polymerase of claim 1 which is one of the following even-numbered amino acid sequences: T569A (SEQ ID NOS: 310-311); D578H (SEQ ID NOS: 320-321); D578R (SEQ ID NOS: 322-323); D578V (SEQ ID NOS: 328-329); I584S (SEQ ID NOS: 330-331); N627R (SEQ ID NOS: 334-335); V631S (SEQ ID NOS: 336-337); W645A (SEQ ID NOS: 340-341); A675F (SEQ ID NOS: 344-345); S699I (SEQ ID NOS: 350-351); D732A (SEQ ID NOS: 354-355); D732K (SEQ ID NOS: 356-357); D732M (SEQ ID NOS: 358-359); D732Y (SEQ ID NOS: 366-367); E742D (SEQ ID NOS: 370-371); E742N (SEQ ID NOS: 382-383); E742P (SEQ ID NOS: 384-385); E742T (SEQ ID NOS: 386-387); E742V (SEQ ID NOS: 388-389); E742Y (SEQ ID NOS: 390-391); E745K (SEQ ID NOS: 392-393); R801D (SEQ ID NOS: 396-397); and E805K (SEQ ID NOS: 400-401).

4. The mutant Taq polymerase of claim 1 wherein the remainder of the mutant polymerase has at least 95% amino acid sequence identity with wild type Taq polymerase.

5. The mutant Taq polymerase of claim 1 wherein the remainder of the mutant polymerase has at least 99% amino acid sequence identity with wild type Taq polymerase.

6. The mutant Taq polymerase of claim 1 having the sequence of one of the even-numbered sequences therein.

7. The mutant Taq polymerase of claim 1 having only one of the amino acid mutations listed, wherein said one of the amino acid mutations listed includes single amino acid substitutions and each group of two and three amino acid mutations separated with forward slashes and followed by a single amino acid sequence identification number and a single nucleic acid sequence identification number.

8. The mutant Taq polymerase of claim 1 having more than one of the amino acid mutations listed wherein said one of the amino acid mutations listed includes single amino acid substitutions and each group of two and three amino acid mutations separated with forward slashes and followed by a single amino acid sequence identification number and a single nucleic acid sequence identification number.

9. The mutant Taq polymerase of claim 1 wherein the mutant Taq polymerase is capable of extending a primer where the extension conditions are limited to one second.

10. The mutant Taq polymerase of claim 9 wherein the extension temperature is 60° C., and the primer is extended by at least 600 bp in one second.

11. A biologically active fragment of the mutant Taq polymerase of claim 1 including one or more of the amino acid mutations listed, wherein said one of the amino acid mutations listed includes single amino acid substitutions and each group of two and three amino acid mutations separated with forward slashes and followed by a single amino acid sequence identification number and a single nucleic acid sequence identification number.

12. A DNA encoding the mutant Taq polymerases of claim 1.

13. The DNA sequence of claim 12 which is one of the odd-numbered sequences therein.

14. A vector incorporating the DNA sequence of claim 12.

15. A cell transformed with and expressing the DNA sequence of claim 12.

16. A process of conducting PCR, comprising:
adding to a PCR mixture including a target sequence and target sequence primers, a mutant Taq polymerase having one or more of the following amino acid mutations at the positions in the even-numbered sequences, and wherein the remainder of the mutant polymerase has at least 80% amino acid sequence identity with wild type Taq polymerase, as shown in SEQ ID NO: 4 but wherein wild type Taq polymerase does not include the 6-membered histidine tag at its C-terminus and the six immediately preceding Glycine and Serine amino acids shown in SEQ ID NO: 4:

G32P (SEQ ID NOS: 402-403),
T34I (SEQ ID NOS: 408-409),
E39K/E230K (SEQ ID NOS: 28-29), E39K/D320R (SEQ ID NOS: 30-31), E39K/E507K (SEQ ID NOS: 32-33), E39K/E520K (SEQ ID NOS: 34-35), E39K/E537K (SEQ ID NOS: 36-37), E39K/D578R (SEQ ID NOS: 38-39), E39K/D732R (SEQ ID NOS: 40-41), E39K/E742K (SEQ ID NOS: 42-43), E39K/E189K (SEQ ID NOS: 44-45),
Q42R (SEQ ID NOS: 406-407),
E101K (SEQ ID NOS: 46-47),
V103S (SEQ ID NOS: 410-411),
Y116A (SEQ ID NOS: 412-413),
E117K (SEQ ID NOS: 48-49),
E130K (SEQ ID NOS: 50-51),
D144R (SEQ ID NOS: 6-7),
E159K (SEQ ID NOS: 56-57),
I163S (SEQ ID NOS: 404-405),
E189C (SEQ ID NOS: 58-59), E189D (SEQ ID NOS: 60-61), E189K (SEQ ID NOS: 62-63),
E189K/E230K (SEQ ID NOS: 64-65), E189K/E507K (SEQ ID NOS: 66-67), E189K/E537K (SEQ ID NOS: 68-69), E189K/D578R (SEQ ID NOS: 70-71), E189K/D732R (SEQ ID NOS: 72-73), E189K/E742K (SEQ ID NOS: 74-75),
E189K/E230K/E537K (SEQ ID NOS: 76-77), E189K/E507K/E537K (SEQ ID NOS: 78-79), E189K/E520K/E537K (SEQ ID NOS: 80-81), E189K/E230K/E520K (SEQ ID NOS: 84-85), E189K/E230K/D578R (SEQ ID NOS: 86-87), E189K/E507K/D578R (SEQ ID NOS: 88-89), E189K/E230K/D732R (SEQ ID NOS: 90-91), E189K/E537K/D732R (SEQ ID NOS: 92-93), E189K/E507K/E520K (SEQ ID NOS: 94-95), E189K/E537K/D578R (SEQ ID NOS: 96-97), E189K/E537K/E742K (SEQ ID NOS: 98-99), E189K/D732R/E742K (SEQ ID NOS: 100-101),
E189L (SEQ ID NOS: 102-103), E189M (SEQ ID NOS: 104-105), E189P (SEQ ID NOS: 106-107), E189Q (SEQ ID NOS: 108-109), E189R (SEQ ID NOS: 110-111), E189T (SEQ ID NOS: 112-113), E189W (SEQ ID NOS: 114-115),
E201K (SEQ ID NOS: 116-117),
E230C (SEQ ID NOS: 122-123), E230F (SEQ ID NOS: 124-125), E230H (SEQ ID NOS: 126-127), E230K (SEQ ID NOS: 128-129),
E230K/E520K (SEQ ID NOS: 132-133), E230K/E537K (SEQ ID NOS: 134-135), E230K/D578R (SEQ ID NOS: 136-137), E230K/D732R (SEQ ID NOS: 138-139), E230K/E742K (SEQ ID NOS: 140-141),
E230K/E507K/E520K (SEQ ID NOS: 142-143), E230K/E507K/E537K (SEQ ID NOS: 144-145), E230K/E520K/D578R (SEQ ID NOS: 146-147), E230K/E537K/D578R (SEQ ID NOS: 148-149), E230K/E537K/D732R (SEQ ID NOS: 150-151), E230K/E507K/E742K (SEQ ID NOS: 152-153), E230K/E520K/E742K (SEQ ID NOS: 154-155), E230K/E537K/E742K (SEQ ID NOS: 156-157), E230K/D578R/E742K (SEQ ID NOS: 158-159), E230K/D732R/E742K (SEQ ID NOS: 160-161),
E230M (SEQ ID NOS: 162-163), E230N (SEQ ID NOS: 164-165), E230P (SEQ ID NOS: 166-167), E230Q (SEQ ID NOS: 168-169), E230R (SEQ ID NOS: 170-171), E230S (SEQ ID NOS: 172-173), E230T (SEQ ID NOS: 174-175), E230V (SEQ ID NOS: 176-177), E230W (SEQ ID NOS: 178-179), E230Y (SEQ ID NOS: 180-181),
D320R (SEQ ID NOS: 184-185),
L322S (SEQ ID NOS: 186-187),
A323F (SEQ ID NOS: 188-189),
R328D (SEQ ID NOS: 190-191),
G330P (SEQ ID NOS: 192-193),
R334D (SEQ ID NOS: 194-195),
P336G (SEQ ID NOS: 196-197),
E337K (SEQ ID NOS: 198-199),
P338G (SEQ ID NOS: 200-201),
Y339A (SEQ ID NOS: 202-203),
D344R (SEQ ID NOS: 204-205),
E347K (SEQ ID NOS: 206-207),
A348F (SEQ ID NOS: 208-209),
R349D (SEQ ID NOS: 210-211),
L351S (SEQ ID NOS: 212-213),
L361S (SEQ ID NOS: 214-215),
L365S (SEQ ID NOS: 216-217),
G366P (SEQ ID NOS: 218-219),
P368G (SEQ ID NOS: 220-221),
M374S (SEQ ID NOS: 222-223),
L380S (SEQ ID NOS: 224-225),
D381R (SEQ ID NOS: 226-227),
P382G (SEQ ID NOS: 228-229),
S383I (SEQ ID NOS: 230-231),
N384R (SEQ ID NOS: 232-233),
A391F (SEQ ID NOS: 234-235),
A407F (SEQ ID NOS: 240-241),
A414F (SEQ ID NOS: 242-243),
E507Q (SEQ ID NOS: 270-271), E507R (SEQ ID NOS: 272-273), E507S (SEQ ID NOS: 274-275), E507T (SEQ ID NOS: 276-277), E507Y (SEQ ID NOS: 278-279),
E507K/E520K (SEQ ID NOS: 246-247), E507K/E537K (SEQ ID NOS: 248-249), E507K/D578R (SEQ ID NOS: 250-251), E507K/D732R (SEQ ID NOS: 252-253), E507K/E742K (SEQ ID NOS: 254-255),
E507K/E537K/D578R (SEQ ID NOS: 256-257), E507K/D578R/D732R (SEQ ID NOS: 258-259), E507K/E520K/E537K (SEQ ID NOS: 260-261), E507K/E520K/D578R (SEQ ID NOS: 262-263), E507K/E520K/E742K (SEQ ID NOS: 264-265), E507K/E537K/E742K (SEQ ID NOS: 266-267), E507K/D732R/E742K (SEQ ID NOS: 268-269),
E520V (SEQ ID NOS: 282-283),
E520K/E537K (SEQ ID NOS: 284-285), E520K/E537K/E742K (SEQ ID NOS: 300-301),
E537A (SEQ ID NOS: 286-287), E537F (SEQ ID NOS: 288-289), E537I (SEQ ID NOS: 290-291), E537K (SEQ ID NOS: 292-293),
E537K/D732R (SEQ ID NOS: 294-295), E537K/E742K (SEQ ID NOS: 296-297),
E537K/D578R/D732R (SEQ ID NOS: 298-299),
E537R (SEQ ID NOS: 302-303), E537Y (SEQ ID NOS: 304-305),
L541S (SEQ ID NOS: 306-307),
N565R (SEQ ID NOS: 308-309),
T569A (SEQ ID NOS: 310-311),
A570F (SEQ ID NOS: 312-313),
S575I (SEQ ID NOS: 314-315),
S577I (SEQ ID NOS: 316-317),

D578F (SEQ ID NOS: 318-319), D578H (SEQ ID NOS: 320-321), D578R (SEQ ID NOS: 322-323), D578S (SEQ ID NOS: 8-9),
D578R/D732R (SEQ ID NOS: 324-325), D578R/E742K (SEQ ID NOS: 326-327),
D578V (SEQ ID NOS: 328-329),
I584S (SEQ ID NOS: 330-331),
N627R (SEQ ID NOS: 334-335),
V631S (SEQ ID NOS: 336-337),
H639E (SEQ ID NOS: 338-339),
W645A (SEQ ID NOS: 340-341),
T664I (SEQ ID NOS: 342-343),
A675F (SEQ ID NOS: 344-345),
S699I (SEQ ID NOS: 350-351),
D732A (SEQ ID NOS: 354-355), D732C (SEQ ID NOS: 10-11), D732H (SEQ ID NOS: 14-15), D732K (SEQ ID NOS: 356-357), D732M (SEQ ID NOS: 358-359), D732P (SEQ ID NOS: 18-19), D732Q (SEQ ID NOS: 20-21), D732S (SEQ ID NOS: 22-23), D732T (SEQ ID NOS: 24-25), D732V (SEQ ID NOS: 364-365), D732Y (SEQ ID NOS: 366-367),
D732R/E742K (SEQ ID NOS: 362-363),
E742D (SEQ ID NOS: 370-371), E742F (SEQ ID NOS: 372-373), E742I (SEQ ID NOS: 376-377), E742K (SEQ ID NOS: 378-379), E742M (SEQ ID NOS: 380-381), E742N (SEQ ID NOS: 382-383), E742P (SEQ ID NOS: 384-385), E742T (SEQ ID NOS: 386-387), E742V (SEQ ID NOS: 388-389), E742Y (SEQ ID NOS: 390-391),
E745K (SEQ ID NOS: 392-393),
M751S (SEQ ID NOS: 394-395),
R801D (SEQ ID NOS: 396-397),
and
E805K (SEQ ID NOS: 400-401); and
amplifying the target sequence by temperature cycling to cause annealing of the primers to the target sequence and wherein conditions for extension of the primers are limited to one second or less, followed by deannealing of the extended primers.

17. The process of claim 16 wherein the extension period is one second or less.

18. The process of claim 16 wherein the primer is extended by at least 600 bp.

19. The process of claim 16 wherein the remainder of the mutant polymerase has at least 95% amino acid sequence identity with wild type Taq polymerase.

20. The process of claim 16 wherein the remainder of the mutant polymerase has at least 99% amino acid sequence identity with wild type Taq polymerase.

21. The process of claim 16 wherein the mutant polymerase has the amino acid sequence of one of the even-numbered sequences therein.

22. A process of conducting PCR comprising:
adding to a PCR mixture including a target sequence and target sequence primers, a mutant Taq polymerase having one or more of the following amino acid mutations at the positions E39K (SEQ ID NOS: 26-27); K131E (SEQ ID NOS: 52-53); E132K (SEQ ID NOS: 54-55); E209K (SEQ ID NOS: 118-119); E230A (SEQ ID NOS: 120-121); E315K (SEQ ID NOS: 182-183); E397K (SEQ ID NOS: 236-237); E401K (SEQ ID NOS: 238-239); V518A (SEQ ID NOS: 280-281); E626K (SEQ ID NOS: 332-333); E694K (SEQ ID NOS: 346-347); Q698R (SEQ ID NOS: 348-349); E708K (SEQ ID NOS: 352-353); D732G (SEQ ID NOS: 12-13); D732N (SEQ ID NOS: 16-17); and K804E (SEQ ID NOS: 398-399), wherein the remainder of the mutant polymerase has at least 80% amino acid sequence identity with wild type Taq polymerase, as shown in SEQ ID NO: 4 but wherein wild type Taq polymerase does not include the 6-membered histidine tag at its C-terminus or the immediately preceding 6 amino acids: GSGSSG, as in SEQ ID NO: 4;
amplifying the target sequence by temperature cycling to cause annealing of the primers to the target sequence and wherein conditions for extension of the primers are limited to one second or less, followed by deannealing of the extended primers.

23. The process of claim 22 wherein the primer is extended by at least 600 bp.

24. The process of claim 22 wherein the remainder of the mutant polymerase has at least 95% amino acid sequence identity with wild type Taq polymerase.

25. The process of claim 22 wherein the remainder of the mutant polymerase has at least 99% amino acid sequence identity with wild type Taq polymerase.

26. The process of claim 22 wherein the mutant polymerase has the amino acid sequence of one of the even-numbered sequences therein.

* * * * *

(12) EX PARTE REEXAMINATION CERTIFICATE (12985th)
United States Patent
Zhu et al.

(10) Number: US 10,865,441 C1
(45) Certificate Issued: Jul. 15, 2025

(54) MUTANT TAQ POLYMERASE FOR FASTER AMPLIFICATION

(71) Applicant: AbClonal Science, Inc., Woburn, MA (US)

(72) Inventors: Zhenyu Zhu, Lynnfield, MA (US); Dapeng Sun, Lexington, MA (US)

(73) Assignee: ABCLONAL SCIENCE, INC., Woburn, MA (US)

Reexamination Request:
No. 90/019,548, Jun. 25, 2024

Reexamination Certificate for:
Patent No.: 10,865,441
Issued: Dec. 15, 2020
Appl. No.: 16/813,425
Filed: Mar. 9, 2020

Related U.S. Application Data

(60) Provisional application No. 62/818,011, filed on Mar. 13, 2019.

(51) Int. Cl.
*C12N 9/52* (2006.01)
*C12N 9/12* (2006.01)
*C12N 15/63* (2006.01)
*C12Q 1/686* (2018.01)

(52) U.S. Cl.
CPC ............... *C12Q 1/686* (2013.01); *C12N 9/12* (2013.01); *C12N 15/63* (2013.01); *C12Q 2521/10* (2013.01); *C12Q 2527/101* (2013.01); *C12Q 2533/101* (2013.01)

(58) Field of Classification Search
None
See application file for complete search history.

(56) References Cited

To view the complete listing of prior art documents cited during the proceeding for Reexamination Control Number 90/019,548, please refer to the USPTO's Patent Electronic System.

*Primary Examiner* — Kevin S Orwig

(57) ABSTRACT

The invention includes a mutant Taq polymerase, which can significantly extend and amplify a target sequence where the extension conditions are time limited to as little as one second. The mutant Taq polymerase, or a biologically active fragment thereof, has one or more substitutions differing from the wild type as shown in Table I.

US 10,865,441 C1

EX PARTE REEXAMINATION CERTIFICATE

THE PATENT IS HEREBY AMENDED AS INDICATED BELOW.

Matter enclosed in heavy brackets [ ] appeared in the patent, but has been deleted and is no longer a part of the patent; matter printed in italics indicates additions made to the patent.

AS A RESULT OF REEXAMINATION, IT HAS BEEN DETERMINED THAT:

Claims 4-5 are cancelled.

Claims 1, 2 and 16 are determined to be patentable as amended.

Claims 7-12, 14, 15 and 17-20, dependent on an amended claim, are determined to be patentable.

Claims 3, 6, 13 and 21-26 were not reexamined.

1. A mutant Taq polymerase comprising: one or more of the following amino acid mutations shown in the following even-numbered sequences, and wherein the remainder of the mutant polymerase has at least [80%] *99.6%* amino acid sequence identity with wild type Taq polymerase, as shown in SEQ ID NO: 4 *but wherein wild type Taq polymerase does not include the 6-membered histidine tag at its C-terminus and the six immediately preceding Glycine and Serine amino acids shown in SEQ ID NO: 4*:

G32P (SEQ ID NOS: 402-403),
T34I (SEQ ID NOS: 408-409),
E39K/E230K (SEQ ID NOS: 28-29), E39K/D320R (SEQ ID NOS: 30-31), E39K/E507K (SEQ ID NOS: 32-33), E39K/E520K (SEQ ID NOS: 34-35), E39K/E537K (SEQ ID NOS: 36-37), E39K/D578R (SEQ ID NOS: 38-39), E39K/D732R (SEQ ID NOS: 40-41), E39K/B742K (SEQ ID NOS: 42-43), E39K/E189K (SEQ ID NOS: 44-45),
Q42R (SEQ ID NOS: 406-407),
E101K (SEQ ID NOS: 46-47),
V103S (SEQ ID NOS: 410-411),
Y116A (SEQ ID NOS: 412-413),
E117K (SEQ ID NOS: 48-49),
E130K (SEQ ID NOS: 50-51),
D144R (SEQ ID NOS: 6-7),
E159K (SEQ ID NOS: 56-57),
I163S (SEQ ID NOS: 404-405),
E189C (SEQ ID NOS: 58-59), E189D (SEQ ID NOS: 60-61), E189K/E507K (SEQ ID NOS: 66-67), E189K/E537K (SEQ ID NOS: 68-69), E189K/D578R (SEQ ID NOS: 70-71), E189K/D732R (SEQ ID NOS: 72-73), E189K/E742K (SEQ ID NOS: 74-75),
E189K/E230K/E537K (SEQ ID NOS: 76-77), E189K/E507K/B537K (SEQ ID NOS: 78-79), E189K/E520K/E537K (SEQ ID NOS: 80-81), E189K/E230K/E520K (SEQ ID NOS: 84-85), E189K/E230K/D578R (SEQ ID NOS: 86-87), E189K/B507K/D578R (SEQ ID NOS: 88-89), E189K/E230K/D732R (SEQ ID NOS: 90-91), E189K/E537K/D732R (SEQ ID NOS: 92-93), E189K/E507K/ES520K (SEQ ID NOS: 94-95), E189K/E537K/D578R (SEQ ID NOS: 96-97), E189K/B537K/E742K (SEQ ID NOS: 98-99), E189K/D732R/E742K (SEQ ID NOS: 100-101),
E189L (SEQ ID NOS: 102-103), E189M (SEQ ID NOS: 104-105), E189P (SEQ ID NOS: 106-107), E189Q (SEQ ID NOS: 108-109), E189R (SEQ ID NOS: 110-111), E189T (SEQ ID NOS: 112-113), E189W (SEQ ID NOS: 114-115),
E201K (SEQ ID NOS: 116-117),
E230C (SEQ ID NOS: 122-123), E230F (SEQ ID NOS: 124-125), E230H (SEQ ID NOS: 126-127),
E230K/E520K (SEQ ID NOS: 132-133), E230K/E537K (SEQ ID NOS: 134-135), E230K/D578R (SEQ ID NOS: 136-137), E230K/D732R (SEQ ID NOS: 138-139), E230K/E742K (SEQ ID NOS: 140-141),
E230K/B507K/E520K (SEQ ID NOS: 142-143), E230K/E507K/E537K (SEQ ID NOS: 144-145), E230K/E520K/D578R (SEQ ID NOS: 146-147), E230K/E537K/D578R (SEQ ID NOS: 148-149), E230K/E537K/D732R (SEQ ID NOS: 150-151), E230K/E507K/E742K (SEQ ID NOS: 152-153), E230K/E520K/E742K (SEQ ID NOS: 154-155), E230K/E537K/E742K (SEQ ID NOS: 156-157), E230K/D578R/E742K (SEQ ID NOS: 158-159), E230K/D732R/E742K (SEQ ID NOS: 160-161),
E230M (SEQ ID NOS: 162-163), E230N (SEQ ID NOS: 164-165), E230P (SEQ ID NOS: 166-167), E230Q (SEQ ID NOS: 168-169), E230R (SEQ ID NOS: 170-171), E230S (SEQ ID NOS: 172-173), E230T (SEQ ID NOS: 174-175), E230V (SEQ ID NOS: 176-177), E230W (SEQ ID NOS: 178-179), E230Y (SEQ ID NOS: 180-181),
D320R (SEQ ID NOS: 184-185),
L322S (SEQ ID NOS: 186-187),
A323F (SEQ ID NOS: 188-189),
R328D (SEQ ID NOS: 190-191),
G330P (SEQ ID NOS: 192-193),
R334D (SEQ ID NOS: 194-195),
P336G (SEQ ID NOS: 196-197),
E337K (SEQ ID NOS: 198-199),
P338G (SEQ ID NOS: 200-201),
Y339A (SEQ ID NOS: 202-203),
D344R (SEQ ID NOS: 204-205),
E347K (SEQ ID NOS: 206-207),
A348F (SEQ ID NOS: 208-209),
R349D (SEQ ID NOS: 210-211),
L351S (SEQ ID NOS: 212-213),
L361S (SEQ ID NOS: 214-215),
L365S (SEQ ID NOS: 216-217),
G366P (SEQ ID NOS: 218-219),
P368G (SEQ ID NOS: 220-221),
M374S (SEQ ID NOS: 222-223),
L380S (SEQ ID NOS: 224-225),
D381R (SEQ ID NOS: 226-227),
P382G (SEQ ID NOS: 228-229),
S383I (SEQ ID NOS: 230-231),
N384R (SEQ ID NOS: 232-233),
A391F (SEQ ID NOS: 234-235),
A407F (SEQ ID NOS: 240-241),
A414F (SEQ ID NOS: 242-243),
[E507Q (SEQ ID NOS: 270-271),] E507R (SEQ ID NOS: 272-273), E507S (SEQ ID NOS: 274-275), E507T (SEQ ID NOS: 276-277), E507Y (SEQ ID NOS: 278-279),
E507K/E520K (SEQ ID NOS: 246-247), E507K/E537K (SEQ ID NOS: 248-249), E507K/D578R (SEQ ID NOS: 250-251), E507K/D732R (SEQ ID NOS: 252-253), E507K/E742K (SEQ ID NOS: 254-255),
E507K/E537K/D578R (SEQ ID NOS: 256-257), E507K/D578R/D732R (SEQ ID NOS: 258-259), E507K/E520K/E537K (SEQ ID NOS: 260-261), E507K/E520K/D578R (SEQ ID NOS: 262-263), E507K/

E520K/E742K (SEQ ID NOS: 264-265), E507K/E537K/E742K (SEQ ID NOS: 266-267), E507K/D732R/E742K (SEQ ID NOS: 268-269),
E520V (SEQ ID NOS: 282-283),
E520K/E537K (SEQ ID NOS: 284-285), E520K/E537K/E742K (SEQ ID NOS: 300-301),
E537A (SEQ ID NOS: 286-287), E537F (SEQ ID NOS: 288-289), E537I (SEQ ID NOS: 290-291), E537K (SEQ ID NOS: 292-293),
E537K/D732R (SEQ ID NOS: 294-295), E537K/E742K (SEQ ID NOS: 296-297),
E537K/D578R/D732R (SEQ ID NOS: 298-299), E537R (SEQ ID NOS: 302-303), E537Y (SEQ ID NOS: 304-305),
L541S (SEQ ID NOS: 306-307),
N565R (SEQ ID NOS: 308-309),
T569A (SEQ ID NOS: 310-311),
A570F (SEQ ID NOS: 312-313),
S575I (SEQ ID NOS: 314-315),
S577I (SEQ ID NOS: 316-317),
D578F (SEQ ID NOS: 318-319), D578H (SEQ ID NOS: 320-321), D578R (SEQ ID NOS: 322-323), D578S (SEQ ID NOS: 8-9),
D578R/D732R (SEQ ID NOS: 324-325), D578R/E742K (SEQ ID NOS: 326-327),
D578V (SEQ ID NOS: 328-329),
1584S (SEQ ID NOS: 330-331),
N627R (SEQ ID NOS: 334-335),
V631S (SEQ ID NOS: 336-337),
H639E (SEQ ID NOS: 338-339),
W645A (SEQ ID NOS: 340-341),
A675F (SEQ ID NOS: 344-345),
S699I (SEQ ID NOS: 350-351),
D732A (SEQ ID NOS: 354-355), D732C (SEQ ID NOS: 10-11), D732H (SEQ ID NOS: 14-15), D732K (SEQ ID NOS: 356-357), D732M (SEQ ID NOS: 358-359), D732P (SEQ ID NOS: 18-19), D732Q (SEQ ID NOS: 20-21), D732S (SEQ ID NOS: 22-23), D732T (SEQ ID NOS: 24-25), D732V (SEQ ID NOS: 364-365), D732Y (SEQ ID NOS: 366-367),
D732R/E742K (SEQ ID NOS: 362-363),
E742D (SEQ ID NOS: 370-371), E742F (SEQ ID NOS: 372-373), E742I (SEQ ID NOS: 376-377), E742M (SEQ ID NOS: 380-381), E742N (SEQ ID NOS: 382-383), E742P (SEQ ID NOS: 384-385), E742T (SEQ ID NOS: 386-387), E742V (SEQ ID NOS: 388-389), E742Y (SEQ ID NOS: 390-391),
E745K (SEQ ID NOS: 392-393),
M751S (SEQ ID NOS: 394-395),
R801D (SEQ ID NOS: 396-397), and
E805K (SEQ ID NOS: 400-401).

2. [The] *A* mutant Taq polymerase [of claim 1] which is one of the following even-numbered amino acid sequences *but wherein the mutant Taq polymerase does not include the 6-membered histidine tag at its C-terminus and the six immediately preceding Glycine and Serine amino acids which are amino acid numbers 833 to 844 in each of the following even-numbered amino acid sequences*: G32P (SEQ ID NOS: 402-403); Q42R (SEQ ID NOS: 406-407); E101K (SEQ ID NOS: 46-47); V103S (SEQ ID NOS: 410-411); Y116A (SEQ ID NOS: 412-413); E117K (SEQ ID NOS: 48-49); E130K (SEQ ID NOS: 50-51); D144R (SEQ ID NOS: 6-7); E159K (SEQ ID NOS: 56-57); 1163S (SEQ ID NOS: 404-405); E189T (SEQ ID NOS: 112-113); E189W (SEQ ID NOS: 114-115); E201K (SEQ ID NOS: 116-117); E230C (SEQ ID NOS: 122-123); E230F (SEQ ID NOS: 124-125); E230H (SEQ ID NOS: 126-127); E230N (SEQ ID NOS: 164-165); E230P (SEQ ID NOS: 166-167); D320R (SEQ ID NOS: 184-185); L322S (SEQ ID NOS: 186-187); A323F (SEQ ID NOS: 188-189); R328D (SEQ ID NOS: 190-191); G330P (SEQ ID NOS: 192-193); R334D (SEQ ID NOS: 194-195); P336G (SEQ ID NOS: 196-197); E337K (SEQ ID NOS: 198-199); P338G (SEQ ID NOS: 200-201); Y339A (SEQ ID NOS: 202-203); T341 (SEQ ID NOS: 408-409); D344R (SEQ ID NOS: 204-205); E347K (SEQ ID NOS: 206-207); A348F (SEQ ID NOS: 208-209); R349D (SEQ ID NOS: 210-211); L351S (SEQ ID NOS: 212-213); L361S (SEQ ID NOS: 214-215); L365S (SEQ ID NOS: 216-217); G366P (SEQ ID NOS: 218-219); P368G (SEQ ID NOS: 220-221); M374S (SEQ ID NOS: 222-223); L380S (SEQ ID NOS: 224-225); D381R (SEQ ID NOS: 226-227); P382G (SEQ ID NOS: 228-229); S383I (SEQ ID NOS: 230-231); N384R (SEQ ID NOS: 232-233); A391F (SEQ ID NOS: 234-235); A407F (SEQ ID NOS: 240-241); A414F (SEQ ID NOS: 242-243); [E507Q (SEQ ID NOS: 270-271);] E507R (SEQ ID NOS: 272-273); E507T (SEQ ID NOS: 276-277); E520V (SEQ ID NOS: 282-283); E537A (SEQ ID NOS: 286-287); E537F (SEQ ID NOS: 288-289); E537I (SEQ ID NOS: 290-291); E537K (SEQ ID NOS: 292-293); E537R (SEQ ID NOS: 302-303); E537Y (SEQ ID NOS: 304-305); N565R (SEQ ID NOS: 308-309); A570F (SEQ ID NOS: 312-313); S575I (SEQ ID NOS: 314-315); S577I (SEQ ID NOS: 316-317); D578F (SEQ ID NOS: 318-319); D578R (SEQ ID NOS: 322-323).

16. A process of conducting PCR, comprising:
adding to a PCR mixture including a target sequence and target sequence primers, a mutant Taq polymerase having one or more of the following amino acid mutations at the positions in the even-numbered sequences, and wherein the remainder of the mutant polymerase has at least [80%] *99.6%* amino acid sequence identity with wild type Taq polymerase, as shown in SEQ ID NO: 4 but wherein wild type Taq polymerase does not include the 6-membered histidine tag at its C-terminus and the six immediately preceding Glycine and Serine amino acids shown in SEQ ID NO: 4:
G32P (SEQ ID NOS: 402-403),
T34I (SEQ ID NOS: 408-409),
E39K/E230K (SEQ ID NOS: 28-29), E39K/D320R (SEQ ID NOS: 30-31), E39K/E507K (SEQ ID NOS: 32-33), E39K/E520K (SEQ ID NOS: 34-35), E39K/E537K (SEQ ID NOS: 36-37), E39K/D578R (SEQ ID NOS: 38-39), E39K/D732R (SEQ ID NOS: 40-41), E39K/E742K (SEQ ID NOS: 42-43), E39K/E189K (SEQ ID NOS: 44-45),
Q42R (SEQ ID NOS: 406-407),
E101K (SEQ ID NOS: 46-47),
V103S (SEQ ID NOS: 410-411),
Y116A (SEQ ID NOS: 412-413),
E117K (SEQ ID NOS: 48-49),
E130K (SEQ ID NOS: 50-51),
D144R (SEQ ID NOS: 6-7),
E159K (SEQ ID NOS: 56-57),
I163S (SEQ ID NOS: 404-405),
E189C (SEQ ID NOS: 58-59), E189D (SEQ ID NOS: 60-61), E189K (SEQ ID NOS: 62-63),
E189K/E230K (SEQ ID NOS: 64-65), E189K/E507K (SEQ ID NOS: 66-67), E189K/E537K (SEQ ID NOS: 68-69), E189K/D578R (SEQ ID NOS: 70-71), E189K/D732R (SEQ ID NOS: 72-73), E189K/E742K (SEQ ID NOS: 74-75), E189K/E230K/E537K (SEQ ID) NOS: 76-77), E189K/E507K/E537K (SEQ ID NOS: 78-79), E189K/E520K/E537K (SEQ ID NOS: 80-81), E189K/E230K/E520K (SEQ ID NOS: 84-85), E189K/E230K/D578R (SEQ ID NOS: 86-87), E189K/E507K/D578R (SEQ ID NOS: 88-89), E189K/E230K/D732R (SEQ ID NOS: 90-91), E189K/E537K/D732R (SEQ ID NOS: 92-93), E189K/E507K/E520K (SEQ ID NOS: 94-95), B189K/E537K/D578R (SEQ ID NOS: 96-97), E189K/B537K/E742K (SEQ ID NOS: 98-99), E189K/D732R/E742K (SEQ ID NOS: 100-101), E189L (SEQ ID NOS: 102-103), E189M (SEQ ID NOS: 104-105), E189P (SEQ ID NOS: 106-107), E189Q (SEQ ID NOS: 108-109), E189R (SEQ ID NOS: 110-111), E189T (SEQ ID NOS: 112-113), E189W (SEQ ID NOS: 114-115),

E201K (SEQ ID NOS: 116-117),

E230C (SEQ ID NOS: 122-123), E230F (SEQ ID NOS; 124-125), E230H (SEQ ID NOS: 126-127), E230K (SEQ ID NOS: 128-129),

E230K/E520K (SEQ ID NOS: 132-133), E230K/E537K (SEQ ID NOS: 134-135), E230K/D578R (SEQ ID NOS: 136-137), E230K/D732R (SEQ ID NOS: 138-139), E230K/E742K (SEQ ID NOS: 140-141),

E230K/E507K/E520K (SEQ ID NOS: 142-143), E230K/E507K/E537K (SEQ ID NOS: 144-145), E230K/E520K/D578R (SEQ ID NOS: 146-147), E230K/B537K/D578R (SEQ ID NOS: 148-149), E230K/E537K/D732R (SEQ ID NOS: 150-151), E230K/E507K/E742K (SEQ ID NOS: 152-153), E230K/E520K/E742K (SEQ ID NOS: 154-155), E230K/E537K/E742K (SEQ ID NOS: 156-157), E230K/D578R/E742K (SEQ ID NOS: 158-159), E230K/D732R/E742K (SEQ ID NOS: 160-161),

E230M (SEQ ID NOS: 162-163), E230N (SEQ ID NOS: 164-165), E230P (SEQ ID NOS: 166-167), E230Q (SEQ ID NOS: 168-169), E230R (SEQ ID NOS: 170-171), E230S (SEQ ID NOS: 172-173), E230T (SEQ ID NOS: 174-175), E230V (SEQ ID NOS: 176-177), E230W (SEQ ID NOS: 178-179), E230Y (SEQ ID NOS: 180-181),

D320R (SEQ ID NOS: 184-185),
L322S (SEQ ID NOS: 186-187),
A323F (SEQ ID NOS: 188-189),
R328D (SEQ ID NOS: 190-191),
G330P (SEQ ID NOS: 192-193),
R334D (SEQ ID NOS: 194-195),
P336G (SEQ ID NOS: 196-197),
E337K (SEQ ID NOS: 198-199),
P338G (SEQ ID NOS: 200-201),
Y339A (SEQ ID NOS: 202-203),
D344R (SEQ ID NOS: 204-205),
E347K (SEQ ID NOS: 206-207),
A348F (SEQ ID NOS: 208-209),
R349D (SEQ ID NOS: 210-211),
L351S (SEQ ID NOS: 212-213),
L361S (SEQ ID NOS: 214-215),
L365S (SEQ ID NOS: 216-217),
G366P (SEQ ID NOS: 218-219),
P368G (SEQ ID NOS: 220-221),
M374S (SEQ ID NOS: 222-223),
L380S (SEQ ID NOS: 224-225),
D381R (SEQ ID NOS: 226-227),
P382G (SEQ ID NOS: 228-229),
S3831 (SEQ ID NOS: 230-231),
N384R (SEQ ID NOS: 232-233),
A391F (SEQ ID NOS: 234-235),

A407F (SEQ ID NOS: 240-241),
A414F (SEQ ID NOS: 242-243), [E507Q (SEQ ID NOS: 270-271),]
E507R (SEQ ID NOS: 272-273), E507S (SEQ ID NOS: 274-275), E507T (SEQ ID NOS: 276-277), E507Y (SEQ ID NOS: 278-279),
E507K/E520K (SEQ ID NOS: 246-247), E507K/E537K (SEQ ID NOS: 248-249), E507K/D578R (SEQ ID NOS: 250-251), E507K/D732R (SEQ ID NOS: 252-253), E507K/E742K (SEQ ID NOS: 254-255),
E507K/E537K/D578R (SEQ ID NOS: 256-257), E507K/D578R/D732R (SEQ ID NOS: 258-259), E507K/B520K/E537K (SEQ ID NOS: 260-261), E507K/E520K/D578R (SEQ ID NOS: 262-263), E507K/E520K/E742K (SEQ ID NOS: 264-265), E507K/E537K/E742K (SEQ ID NOS: 266-267), E507K/D732R/E742K (SEQ ID NOS: 268-269),
E520V (SEQ ID NOS: 282-283),
E520K/E537K (SEQ ID NOS: 284-285), E520K/E537K/E742K (SEQ ID NOS: 300-301),
E537A (SEQ ID NOS: 286-287), E537F (SEQ ID NOS: 288-289), E537I (SEQ ID NOS: 290-291), B537K (SEQ ID NOS: 292-293),
E537K/D732R (SEQ ID NOS: 294-295), E537K/E742K (SEQ ID NOS: 296-297),
E537K/D578R/D732R (SEQ ID NOS: 298-299),
E537R (SEQ ID NOS: 302-303), E537Y (SEQ ID NOS: 304-305),
L541S (SEQ ID NOS: 306-307),
N565R (SEQ ID NOS: 308-309),
T569A (SEQ ID NOS: 310-311),
A570F (SEQ ID NOS: 312-313),
S575I (SEQ ID NOS: 314-315),
S577I (SEQ ID NOS: 316-317),
D578F (SEQ ID NOS: 318-319), D578H (SEQ ID NOS: 320-321), D578R (SEQ ID NOS: 322-323), D578S (SEQ ID NOS: 8-9),
D578R/D732R (SEQ ID NOS: 324-325), D578R/E742K (SEQ ID NOS: 326-327),
D578V (SEQ ID NOS: 328-329),
I584S (SEQ ID NOS: 330-331),
N627R (SEQ ID NOS: 334-335),
V63IS (SEQ ID NOS: 336-337),
H639E (SEQ ID NOS: 338-339),
W645A (SEQ ID NOS: 340-341),
T664I (SEQ ID NOS: 342-343),
A675F (SEQ ID NOS: 344-345),
S699I (SEQ ID NOS: 350-351),
D732A (SEQ ID NOS: 354-355), D732C (SEQ ID NOS: 10-11), D732H (SEQ ID NOS: 14-15), D732K (SEQ ID NOS: 356-357), D732M (SEQ ID NOS: 358-359), D732P (SEQ ID NOS: 18-19), D732Q (SEQ ID NOS: 20-21), D732S (SEQ ID NOS: 22-23), D732T (SEQ ID NOS: 24-25), D732V (SEQ ID NOS: 364-365), D732Y (SEQ ID NOS: 366-367),
D732R/E742K (SEQ ID NOS: 362-363),
E742D (SEQ ID NOS: 370-371), E742F (SEQ ID NOS: 372-373), E742I (SEQ ID NOS: 376-377), [E742K (SEQ ID NOS: 378-379),] E742M (SEQ ID NOS: 380-381), E742N (SEQ ID NOS: 382-383), E742P (SEQ ID NOS: 384-385), E742T (SEQ ID NOS: 386-387), E742V (SEQ ID NOS: 388-389), E742Y (SEQ ID NOS: 390-391),
E745K (SEQ ID NOS: 392-393),
M751S (SEQ ID NOS: 394-395),
R801D (SEQ ID NOS: 396-397), and
E805K (SEQ ID NOS: 400-401); and
amplifying the target sequence by temperature cycling to cause annealing of the primers to the target sequence and wherein conditions for extension of the primers are limited to one second or less, followed by deannealing of the extended primers.

\* \* \* \* \*